US012692483B2

(12) United States Patent
Luginbuhl et al.

(10) Patent No.: US 12,692,483 B2
(45) Date of Patent: **\*Jul. 28, 2026**

(54) PROTEIN-BASED PURIFICATION MATRICES AND METHODS OF USING THE SAME

(71) Applicant: Donaldson Company, Inc., Bloomington, MN (US)

(72) Inventors: Kelli M. Luginbuhl, Durham, NC (US); Michael Dzuricky, Durham, NC (US)

(73) Assignee: Donaldson Company, Inc., Bloomington, MN (US)

( \* ) Notice: Subject to any disclaimer, the term of this patent is extended or adjusted under 35 U.S.C. 154(b) by 632 days.

This patent is subject to a terminal disclaimer.

(21) Appl. No.: 18/158,255

(22) Filed: Jan. 23, 2023

(65) Prior Publication Data

US 2023/0340426 A1 Oct. 26, 2023

Related U.S. Application Data

(63) Continuation of application No. 17/493,938, filed on Oct. 5, 2021, now Pat. No. 11,591,576, which is a continuation of application No. PCT/US2021/018805, filed on Feb. 19, 2021.

(60) Provisional application No. 62/978,615, filed on Feb. 19, 2020.

(51) Int. Cl.

| | |
|---|---|
| *C07K 14/78* | (2006.01) |
| *C07K 14/155* | (2006.01) |
| *C07K 14/16* | (2006.01) |
| *C07K 14/705* | (2006.01) |
| *C07K 19/00* | (2006.01) |
| *C12N 7/02* | (2006.01) |
| *G01N 33/53* | (2006.01) |
| *G01N 33/566* | (2006.01) |
| *G01N 33/569* | (2006.01) |

(52) U.S. Cl.
CPC .............. *C12N 7/02* (2013.01); *C07K 14/155* (2013.01); *C07K 14/16* (2013.01); *C07K 14/705* (2013.01); *C07K 14/78* (2013.01); *C07K 19/00* (2013.01); *G01N 33/53* (2013.01); *G01N 33/566* (2013.01); *G01N 33/56983* (2013.01); *C07K 2319/00* (2013.01); *C12N 2740/15011* (2013.01); *C12N 2740/15051* (2013.01)

(58) Field of Classification Search
CPC .. C12N 7/00; C12N 7/02; C12N 2740/15011; C12N 2740/15051; G01N 33/66; G01N 33/53; G01N 33/569; G01N 33/56983; C07K 14/78; C07K 14/705; C07K 14/15; C07K 14/155; C07K 14/16; C07K 19/00; C07K 2319/00
See application file for complete search history.

(56) References Cited

U.S. PATENT DOCUMENTS

| | | | |
|---|---|---|---|
| 5,283,173 | A | 2/1994 | Fields et al. |
| 5,468,614 | A | 11/1995 | Fields et al. |
| 6,410,300 | B1 | 6/2002 | Samulski et al. |
| 6,582,926 | B1 | 6/2003 | Chilkoti |
| 6,703,222 | B2 | 3/2004 | Rubinstein et al. |
| 6,852,834 | B2 | 2/2005 | Chilkoti |
| 9,616,138 | B1 | 4/2017 | Iglesias et al. |
| 9,932,575 | B2 | 4/2018 | McPherson et al. |
| 10,323,076 | B2 | 6/2019 | Ellsworth et al. |
| 10,385,115 | B2 | 8/2019 | Chilkoti et al. |
| 10,428,137 | B2 | 10/2019 | Schiller et al. |
| 10,633,662 | B2 | 4/2020 | Pillay et al. |
| 11,015,174 | B2 | 5/2021 | Lock et al. |
| 11,021,689 | B2 | 6/2021 | Brument |
| 11,155,584 | B2 | 10/2021 | Chilkoti et al. |
| 11,156,608 | B2 | 10/2021 | Tsourkas et al. |
| 11,591,576 | B2 | 2/2023 | Luginbuhl et al. |
| 11,739,126 | B2 | 8/2023 | Luginbuhl et al. |
| 12,162,908 | B2 | 12/2024 | Luginbuhl et al. |
| 12,269,847 | B2 | 4/2025 | Luginbuhl et al. |
| 2003/0149237 | A1 | 8/2003 | Vernet et al. |
| 2003/0194704 | A1 | 10/2003 | Penn et al. |
| 2005/0255554 | A1 | 11/2005 | Chilkoti |
| 2011/0039776 | A1 | 2/2011 | Chilkoti |
| 2012/0121709 | A1 | 5/2012 | Chilkoti et al. |
| 2012/0122153 | A1 | 5/2012 | Bedzyk et al. |
| 2012/0213781 | A1 | 8/2012 | Hilbert |
| 2013/0281624 | A1 | 10/2013 | Chilkoti et al. |
| 2015/0112022 | A1 | 4/2015 | Chilkoti et al. |
| 2018/0037609 | A1 | 2/2018 | Chilkoti et al. |
| 2018/0327752 | A1 | 11/2018 | Pillay et al. |

(Continued)

FOREIGN PATENT DOCUMENTS

| | | |
|---|---|---|
| CA | 2012311 C | 6/2003 |
| CN | 104725515 A | 6/2015 |

(Continued)

OTHER PUBLICATIONS

Extended European Search Report for European Application No. EP21756728.8 dated Feb. 26, 2024, 10 pages.

(Continued)

*Primary Examiner* — Bridget E Bunner

(74) *Attorney, Agent, or Firm* — COOLEY LLP

(57) ABSTRACT

Provided herein are protein-based purification matrices and methods of use thereof to purify biologics and/or to remove contaminants from a composition. Methods of bringing two or more biologics in close proximity are also provided. The disclosed compositions and methods allow for faster, more efficient purification of a biologic compared to traditional affinity chromatography.

21 Claims, 28 Drawing Sheets

Specification includes a Sequence Listing.

(56) References Cited

U.S. PATENT DOCUMENTS

| | | |
|---|---|---|
| 2019/0048039 A1 | 2/2019 | Chen et al. |
| 2019/0055523 A1 | 2/2019 | Lock et al. |
| 2019/0282656 A1 | 9/2019 | Mackay et al. |
| 2019/0328662 A1 | 10/2019 | Chilkoti et al. |
| 2020/0017557 A1 | 1/2020 | Chilkoti et al. |
| 2021/0261626 A1 | 8/2021 | Luginbuhl et al. |
| 2021/0340186 A1 | 11/2021 | Luginbuhl et al. |
| 2022/0010288 A1 | 1/2022 | Luginbuhl et al. |
| 2022/0098248 A1 | 3/2022 | Chilkoti et al. |
| 2023/0099707 A1 | 3/2023 | Luginbuhl et al. |
| 2023/0348863 A1 | 11/2023 | Luginbuhl et al. |
| 2023/0391832 A1 | 12/2023 | Luginbuhl |
| 2024/0002448 A1 | 1/2024 | Luginbuhl et al. |
| 2024/0018202 A1 | 1/2024 | Votaw |
| 2024/0254430 A1 | 8/2024 | Zhang et al. |
| 2024/0317837 A1 | 9/2024 | Luginbuhl |
| 2025/0066759 A1 | 2/2025 | Dzuricky et al. |
| 2025/0171503 A1 | 5/2025 | Luginbuhl |

FOREIGN PATENT DOCUMENTS

| | | |
|---|---|---|
| CN | 105175554 A | 12/2015 |
| EP | 1908777 B1 | 2/2016 |
| KR | 101741873 B1 | 6/2017 |
| WO | WO-2004113494 A2 | 12/2004 |
| WO | WO-2006110292 A2 | 10/2006 |
| WO | WO-2013111110 A2 | 8/2013 |
| WO | WO-2014026054 A2 | 2/2014 |
| WO | WO-2015130846 A2 | 9/2015 |
| WO | WO-2016154530 A1 | 9/2016 |
| WO | WO-2018057847 A1 | 3/2018 |
| WO | WO-2020037100 A1 | 2/2020 |
| WO | WO-2021106882 A1 | 6/2021 |
| WO | WO-2021168270 A1 | 8/2021 |
| WO | WO-2021168276 A1 | 8/2021 |
| WO | WO-2021178481 A1 | 9/2021 |
| WO | WO-2021178483 A2 | 9/2021 |
| WO | WO-2022178537 A1 | 8/2022 |
| WO | WO-2023212694 A2 | 11/2023 |
| WO | WO-2024015853 A2 | 1/2024 |
| WO | WO-2025043174 A1 | 2/2025 |

OTHER PUBLICATIONS

Extended European Search Report for European Application No. EP21757068.8 dated Mar. 4, 2024, 13 pages.

Gilroy et al., "Fusion of fibroblast growth factor 21 to a thermally responsive biopolymer forms an injectable depot with sustained anti-diabetic action," Journal of Controlled Release, May 2018, 277:154- 164.

Guo et al., "A novel elastin-like polypeptide drug carrier for cyclosporine A improves tear flow in a mouse model of Sjogren's Syndrome". J Control Release. 2018, vol. 292, pp. 183-195.

International Search Report and Written Opinion for International Application No. PCT/US2023/070044 dated Feb. 15, 2024, 15 pages.

Kim et al., "AAVR-displaying interfaces: serotype-independent adeno-associated virus capture and local delivery systems". Molecular Therapy-Nucleic Acids. Dec. 6, 2019; 18: 432-43.

Nikolic et al., "Structural basis for the recognition of LDL-receptor family members by VSV glycoprotein". Nat Commun. 2018, vol. 9: 12 pages.

Ruff et al., "Advances in Understanding Stimulus Responsive Phase Behavior of Intrinsically Disordered Protein Polymers". J Mol Biol. Nov. 2, 2018; 430(23): 4619- 4635.

Segura et al., "New developments in lentiviral vector design, production and purification". Expert opinion on biological therapy. Aug. 1, 2013; 13(7): 987-1011.

Velho et al., "Divergent low-density lipoprotein receptor (LDLR) linked to low VSV G-dependent viral infectivity and unique serum lipid profile in zebra finches". Proc Natl Acad Sci US A. 2021, vol. 118(18): 3 pages.

Votaw et al., "IsoTag(TM) LV—A faster and more effective purification solution for lentiviral applications", Human Gene Therapy; 29th Annual Congress of Theeuropean-Society-Of-Gene-And-Cell-Therapy (ESCGT) Edinburgh, UK Oct. 11-14, 2022, vol. 33, No. 23-24, Oct. 11, 2022, 2 pages.

Banerjee et al., "Functions of double-stranded RNA-binding domains in nucleocytoplasmic transport". RNA biology. Oct. 3, 2014; 11(10): 1226-32.

Banjade et al., "Phase transitions of multivalent proteins can promote clustering of membrane receptors," Elife, Oct. 2014, 3: 24 pages.

Barreau et al., "AU-rich elements and associated factors: are there unifying principles?". Nucleic acids research. Jan. 1, 2005; 33(22): 7138-50.

Chaves-Arquero et al., "The distinct RNA-interaction modes of a small ZnF domain underlay TUT4 (7) diverse action in miRNA regulation". RNA biology. Nov. 1, 20212; 18(sup2): 770-81.

Heinemann et al. "Cold-Shock Domains Abundance, Structure, Properties, and Nucleic-Acid Binding". Cancers (Basel) Jan. 7, 2021; 13(2): 22 pages.

Invitation to Pay Additional fees for International Application No. PCT/US2024/043621, mailed Oct. 11, 2024, 3 pages.

Kumar et al., "N-Terminal Region of the Catalytic Domain of Human N-Myristoyltransferase 1 Acts as an Inhibitory Module," PLoS One, May 2015, 10(5): 20 pages.

Maelfait et al.,. "Sensing of viral and endogenous RNA by ZBP 1/DAI induces necroptosis". The EMBO journal. Sep. 1, 2017; 36(17): 2529-43.

MANNA "An overview of pentatricopeptide repeat proteins and their applications". Biochimie. Jun. 1, 2015; 113: 93-9.

Morgan et al., "Probing the structural and dynamical effects of the charged residues of the TZF domain of TIS11d". Biophysical Journal. Mar. 24, 2015; 108(6): 1503-15.

Rha et al., "The RNA-binding protein, ZC3H14, is required for proper poly (A) tail length control, expression of synaptic proteins, and brain function in mice". Human Molecular Genetics. Oct. 1, 2017; 26(19): 3663-81.

Sachs et al., "RNA single strands bind to a conserved surface of the major cold shock protein in crystals and solution". Rna. Jan. 1, 2012; 18(1): 65-76.

Song et al., "Budding-like division of all-aqueous emulsion droplets modulated by networks of protein nanofibrils," Nat Commun, 2018, 9: 7 pages.

Song et al., "The role of RNA editing enzyme ADAR1 in human disease". Wiley Interdisciplinary Reviews: RNA. Jan. 2022;13(1): 35 pages.

U.S. Appl. No. 18/813,397, filed Aug. 23, 2024, by Dzuricky et al.

Visentin et al., "A multipronged approach to understanding the form and function of hStaufen protein". RNA. Mar. 1, 2020; 26(3): 265-77.

Wang, M. et al., "The PUF Protein Family: Overview on Puf Rna Targets, Biological Functions, and Post Transcriptional Regulation," Int. J. Mol. Sci., 19:410 (2018), 13 pages; https://www.ncbi.nlm.nih.gov/pmc/articles/PMC5855632/.

Xing et al., "Negative regulation of RhoA translation and signaling by hnRNP-Q1 affects cellular morphogenesis". Molecular biology of the cell. Apr. 15, 2012; 23(8): 1500-9.

Balu et al., "Resilin-mimetics as a smart biomaterial platform for biomedical applications," Nature Comm, 2021, 12:149, 15 pages.

Bhattacharya et al., "Impact of genetic variation on three dimensional structure and function of proteins," Plos One 12(3): 2017, pp. 1-22.

Bork, P. et al., "Go hunting in sequence databases but watch out for the traps," Trends in Genetics, 12(10): 425-427, 1996.

Bork, P., "Powers and pitfalls in sequence analysis: the 70% hurdle," Genome Res., 10: 398-400, 2000.

Brenner, S. E., "Errors in genome annotation," Trends in Genetics, 15(4): 132-133, 1999.

Christensen et al., "Fusion order controls expression level and activity of elastin-like polypeptide fusion proteins," Protein Science, 2009, vol. 18, 1377-1387.

(56) References Cited

OTHER PUBLICATIONS

Christensen, et al., "Predicting Transition Temperatures of Elastin-Like Polypeptide Fusion Proteins." Biomacromolecules (2013); 14(5): 1514-1519.

Doerks et al., "Protein annotation: detective work for function prediction", Trends in Genetics, vol. 14, No. 6, p. 248-250, 1998.

Dzuricky et al., "Convergence of artificial protein polymers and intrinsically disordered proteins," Biochemistry, 2018, 57: 2405-2414.

Dzuricky et al., "De novo engineering of intracellular condensates using artificial disordered proteins," Nature Chemistry, Sep. 2020, vol. 12, pp. 814-825 (18 pages).

Extended European Search Report for European Application No. 19850360.9 dated Apr. 20, 2022, 12 pages.

Fenton et al., "Rheostat positions: A new classification of protein positions relevant to pharmacogenomics," Medicinal Chem Res, 2020, 29: 1133-1146.

Guo et al., "Rapid and simplified purification of recombinant adeno-associated virus," Journal of Virological Methods (2012) 183, 139-146.

Guo, H. H. et al. (Jun. 2004), "Protein tolerance to random amino acid change," Proc Natl Acad Sci USA, vol. 101, No. 25, pp. 9205-9210. Epub Jun. 14, 2004.

Hassouneh et al., "Elastin-like Polypeptides as a Purification Tag for Recombinant Proteins," Curr Protoc Protein Sci. Aug. 2010; CHAPTER: Unit-6.11, 20 pages.

Hassouneh, W., et al., "Fusions of Elastin-like Polypeptides to Pharmaceutical Proteins," Methods in Enzymology, 2012, vol. 502, Chapter 9, pp. 215-237.

Heider et al., "Integrated Method for Purification and Single-Particle Characterization of Lentiviral Vector Systems by Size Exclusion Chromatography and Tunable Resistive Pulse Sensing," Mol Biotechnol (2017) 59: 251-259.

Huang et al., "Silk-elastin-like protein biomaterials for the controlled delivery of therapeutics," Expert Opinion on Drug Delivery (2015) 12:5, 779-791.

International Search Report and Written Opinion for International Application No. PCT/US2021/018805, mailed Jul. 8, 2021, 13 pages.

International Search Report and Written Opinion for International Application No. PCT/US2021/018812, mailed Jul. 22, 2021, 14 pages.

International Search Report and Written Opinion of the International Searching Authority for International Application No. PCT/US2019/046607 dated Nov. 29, 2019, 13 pages.

Kim et al., "Elastin-like polypeptide matrices for enhancing adeno-associated virus-mediated gene delivery to human neural stem cells," Gene Therapy, (2012) 19, 329-337.

Kowalczyk, T., et al., "Elastin-like polypeptides as a promising family of genetically-engineered protein based polymers." World Journal of Microbiology and Biotechnology (2014); 30(8): 2141-2152.

Kuna et al., "Molecular Size Modulates Pharmacokinetics, Biodistribution, and Renal Deposition of the Drug Delivery Biopolymer elastin-like polypeptide," Scientific Rep (2018) 8:7923, 12 pages.

MacEwan et al. Elastin-like polypeptides: biomedical applications of tunable biopolymers, Biopolymers (Pept Sci), 2010, 94: 60-77.

Merten et al., "Production of lentiviral vectors," Molecular Therapy—Methods & Clinical Development (2016) 3, 16017, 15 pages; doi:10.1038/mtm.2016.17.

Miller, A.D., "Cell-surface receptors for retroviruses and implications for gene transfer," PNAS USA, Oct. 1996, vol. 93, pp. 11407-11413.

Monfort and Koria, "Recombinant elastin based nanoparticles for targeted gene therapy," Gene Ther. Oct. 2017; 24(10): 610-620.

Ngo, J.T., et al., "Computational Complexity, Protein Structure Prediction, and The Levinthal Paradox," The Protein Folding Problem and Tertiary Structure Prediction, Merz et al., (ed.), Birkhauser, Boston, MA, 1994, pp. 491-495.

Ohainle et al., "A balancing act between primate lentiviruses and their receptor," PNAS, 2021, vol. 118, No. 20, e2104741118, 3 pages.

Pillay et al., "Adeno-associated Virus (AAV) Serotypes Have Distinctive Interactions with Domains of the Cellular AAV Receptor," J. Virol (2017) 91:e00891-17, 17 pages.

Pillay et al., "An essential receptor for adeno-associated virus infection," Nature, Feb. 2016, vol. 530, pp. 108-112, 17 pages.

Roberts et al., "Elastin-like polypeptides as models of intrinsically disordered proteins," FEBS Letters, 2015, 589: 2477-2486.

Skolnick J., et al., "From Genes to Protein Structure And Function: Novel Applications of Computational Approaches in the Genomic Era," Trends in Biotechnology, Jan. 2000, vol. 18, pp. 34-39.

Smith et al., "The challenges of genome sequence annotation or 'The devil is in the details," Nature Biotech., 1997, 15: 1222-1223.

Sommerfelt et al., "Retrovirus receptors," J Gen Virol, 1999, 80: 3049-3064.

Teschner et al., "rAAV for Tumor Therapy Using Transcriptional and Translational Control of Suicide Gene Expression Purified by a Newly Developed Affinity Chromatography Based on the PKD Domains of AAVR, " Molecular Therapy, Pharmacology/Toxicology Studies, Abstract 970, vol. 28, No. 4S1, Apr. 28, 2020, p. 422.

Teschner, K. E., "Optimization of rAAV mediated targeted suicide gene therapy, rAAV manufacturing and downstream processing," Dissertation, Universitat Bielefeld, 2019, 229 pages.

Tokuriki et al., "Stability effects of mutations and protein evolvability," Curr Opin Structural Biol, 2009, 19: 596-604.

Uniprot Accession No. P01130 (LDLR_HUMAN), Jul. 21, 1986, 40 pages, retrieved from https://www.uniprot.org/uniprot/P01130.txt.

Wells, James A, "Additivity of mutational effects in proteins", Biochemistry (1990); 29(37): 8509-8517.

Wu et al., "Single-step concentration and purification of adenoviruses by coxsackievirus-adenovirus receptor-binding capture and elastin-like polypeptide- mediated precipitation," Archives of Virology (2016) 161: 279-287.

Yeboah et al., "Elastin-Like Polypeptides: A Strategic Fusion Partner for Biologics," Biotechnology and Bioengineering, Aug. 2016, vol. 113, No. 8, pp. 1617-1627.

Agnello et al., "Hepatitis C virus and other flaviviridae viruses enter cells via low density lipoprotein receptor". Proceedings of the National Academy of Sciences. Oct. 26, 1999;96(22):12766-71.

Daly et al., "Three-dimensional structure of the second cysteine-rich repeat from the human low-density lipoprotein receptor". Biochemistry. Nov. 1, 1995;34(44):14474-81.

Finkelshtein et al., "LDL receptor and its family members serve as the cellular receptors for vesicular stomatitis virus". Proceedings of the National Academy of Sciences. Apr. 30, 2013;110(18):7306-11.

Mangus et al., "Poly (A)-binding proteins: multifunctional scaffolds for the post-transcriptional control of gene expression". Genome biology. Jul. 2003;4:1-4.

U.S. Appl. No. 19/022,823, filed Jan. 15, 2025, by Luginbuhl et al.

International Preliminary Report on Patentability for International Application No. PCT/US2023/066363 mailed Nov. 7, 2024, 7 pages.

International Search Report and Written Opinion for PCT Application No. PCT/US2024/043621 mailed Dec. 10, 2024, 12 pages.

Alberti et al., "A User's Guide for Phase Separation Assays with Purified Proteins," Journal of Molecular Biology, Jun. 18, 2018, pp. 4806-4820, Entire Document; https://doi.org/10.1016/j.jmb.2018.06.038.

Balcerak et al., "RNA-protein interactions: disorder, moonlighting and junk contribute to eukaryotic complexity". Open Biology. Jun. 19, 2019; 9(6): pp. 1-13.

Baou et al., "TIS11 family proteins and their roles in post-transcriptional gene regulation". Journal of Biomedicine and Biotechnology. Jan. 1, 2009; 29: 11 pages.

Brennan et al., "HuR and mRNA stability. Cellular and Molecular Life Sciences CMLS". Feb. 2001; 58: 266-77.

Brise et al., "Comparative structure and function analysis of the RIG-I-like receptors: RIG-I and MDA5". Frontiers in immunology. Jul. 17, 2019; 10: pp. 1-27.

(56) References Cited

OTHER PUBLICATIONS

Carballo et al., "Feedback inhibition of macrophage tumor necrosis factor-α production by tristetraprolin". Science. Aug. 14, 1998; 281(5379): 1001-5.

Corley et al., "How RNA-binding proteins interact with RNA: molecules and mechanisms". Molecular cell. Apr. 2, 2020; 78(1): 9-29.

Costa et al., "Fusion tags for protein solubility, purification and immunogenicity in Escherichia coli: the novel Fh8 system". Frontiers in microbiology. Feb. 19, 2014; 5: pp. 1-20.

De Franco et al., "Exploring the suitability of RanBP2-type Zinc Fingers for RNA-binding protein design". Scientific reports. Feb. 21, 2019; 9(1): pp. 1-13.

Dickson et al., "Ribonuclease inhibitor: structure and function", Prog Nucleic Acid Res Mol Biol, 2005; 80: 349-374.

Ehrlich, P. et al., "Isolation of an active heavy-chain variable domain from a homogeneous rabbit antibody by cathepsin B digestion of the aminoethylated heavy chain," Biochemistry, Aug. 1, 1980, vol. 19, No. 17, pp. 4091-4096.

Elbaum-Garfinkle et al., "The disordered P granule protein LAF-1 drives phase separation into droplets with tunable viscosity and dynamics". Proceedings of the National Academy of Sciences. Jun. 9, 2015; 112(23): 7189-94.

Hochman, J. et al., "Folding and interaction of subunits at the antibody combining site," Biochemistry, Jun. 1, 1976, vol. 15, No. 12, pp. 2706-2710.

Inbar et al., "Localization of antibody-combining sites within the variable portions of heavy and light chains". Proceedings of the National Academy of Sciences. Sep. 1972; 69(9): 2659-62.

International Preliminary Report on Patentability for International Application No. PCT/US2019/046607, mailed on Feb. 16, 2021, 10 pages.

International Preliminary Report on Patentability for International Application No. PCT/US2021/018805, mailed on Sep. 1, 2022, 9 pages.

International Preliminary Report on Patentability for International Application No. PCT/US2022/070727, mailed Aug. 31, 2023, 8 pages.

International Preliminary Report on Patentability for International Application No. PCT/US2021/018812, mailed on Sep. 1, 2022, 10 pages.

International Search Report and Written Opinion for Application No. PCT/US22/70727, mailed on Jul. 5, 2022, 12 pages .

International Search Report and Written Opinion for PCT Application No. PCT/US2023/066363 dated Oct. 6, 2023, 12 pages.

Invitation to pay additional fees for International Application No. PCT/US2023/066363, dated Aug. 10, 2023, 2 pages.

Invitation to Pay Fee for International Application No. PCT/US2022/070727 dated May 4, 2022, 2 pages.

Jarvelin et al., "The new (dis) order in RNA regulation". Cell Communication and Signaling. Dec. 2016; 14(1): 1-22.

Kobori et al., "Heat-labile alkaline phosphatase from Antarctic bacteria: rapid 5' end-labeling of nucleic acids". Proceedings of the National Academy of Sciences. Nov. 1984; 81(21): 6691-5.

Kuroyanagi "Fox-1 family of RNA-binding proteins". Cellular and Molecular Life Sciences. Dec. 2009; 66: 3895-907.

Leacock et al., "MEG-1 and MEG-2 are embryo-specific P-granule components required for germline development in Caenorhabditis elegans". Genetics. Jan. 1, 2008; 178(1): 295-306.

Luo et al., "P-bodies: composition, properties, and functions". Biochemistry. Jan. 30, 2018; 57(17): 2424-31.

Luo et al., "The D1 and D12 subunits are both essential for the transcription termination factor activity of vaccinia virus capping enzyme". Journal of Virology. Jun. 1995; 69(6): 3852-6.

Luo et al., "Structural insights into RNA recognition by RIG-I". Cell. Oct. 14, 2011; 147(2): 409-22.

Mazan-Mamczarz et al., "Identification of a signature motif in target mRNAs of RNA-binding protein AUF1". Nucleic acids research. Jan. 1, 2009; 37(1): 204-14.

Mazan-Mamczarz et al., "Post-transcriptional gene regulation by HuR promotes a more tumorigenic phenotype". Oncogene. Oct. 2008; 27(47): 6151-63.

Otsuka et al., "Emerging evidence of translational control by AU-rich element- binding proteins". Frontiers in Genetics. May 2, 2019; 10: 10 pages.

Rehwinkel et al., "RIG-I-like receptors: their regulation and roles in RNA sensing". Nature Reviews Immunology. Sep. 2020; 20(9): 537-51.

Shotwell et al., The potential of engineered eukaryotic RNA-binding proteins as molecular tools and therapeutics. Wiley Interdisciplinary Reviews: RNA. Jan. 2020; 11(1): pp. 1-21.

Shuman et al., "Purification and characterization of a GTP-pyrophosphate exchange activity from vaccinia virions. Association of the GTP-pyrophosphate exchange activity with vaccinia mRNA guanylyltransferase. RNA (guanine-7-) methyltransferase complex (capping enzyme)". Journal of Biological Chemistry. Dec. 10, 1980; 255(23): 11588-98.

Simon et al., "Engineered ribonucleoprotein granules inhibit translation in protocells". Molecular cell. Jul. 1, 20191; 75(1): 66-75.

Summerford et al., "AAVR: a multi-serotype receptor for AAV". Molecular Therapy. Apr. 1, 2016;24(4): 663-6.

Thandapani et al., "Defining the RGG/RG motif". Molecular cell. Jun. 6, 2013; 50(5): 613-23.

UniProt Consortium. "P01730 . CD4_HUMAN", CD4—T-cell surface glycoprotein CD4—*Homo sapiens* (Human) I UniProtKB I UniProt, [Internet; retrieved Oct. 4, 2023], 11 pages. Available from: https://www.uniprot.org/uniprotkb/P01730/entry.

UniProt Consortium. "Q70AB8_STAAU", spa—Protein A—*Staphylococcus aureus* I UniProtKB I UniProt, [Internet; retrieved Oct. 4, 2023], 6 pages. Available from: https://www.uniprot.org/uniprotkb/Q70AB8/entry.

UniProtKB Accession No. A0A653CGZ9 "Uncharacterized protein" Sep. 29, 2021 [online]. [Retrieved on Sep. 18, 2023]. Retrieved from the internet: URL: https://rest.uniprot.org/unisave/A0A653CGZ9?format=txt&versions=8; entire document, residues 2172-2214.

Valkov et al. "Structure of the Dcp2-Dcp1 mRNA-decapping complex in the activated conformation". Nature Structural & Molecular Biology. Jun. 2016; 23(6): 574-9.

Varadi et al., "Functional advantages of conserved intrinsic disorder in RNA-binding proteins". PloS one. Oct. 6, 2015; 10(10): pp. 1-16.

Vasudevan et al., "AU-rich-element-mediated upregulation of translation by FXR1 and Argonaute 2". Cell. Mar. 23, 2007; 128(6): 1105-18.

Wu et al., "Single-molecule dynamics of the P granule scaffold MEG-3 in the Caenorhabditis elegans zygote". Molecular biology of the cell. Feb. 1, 2019; 30(3): 333-45.

Zeke et al., "Deep structural insights into RNA-binding disordered protein regions". Wiley Interdisciplinary Reviews: RNA. Sep. 2022; 13(5): pp. 1-20.

Zhang et al., "Adeno-associated virus 2 bound to its cellular receptor AAVR". Nature Microbiology. Apr. 2019; 4(4): 675-82.

Zhang et al., "Divergent engagements between adeno-associated viruses with their cellular receptor AAVR". Nature Communications. Aug. 21, 2019; 10(1): pp. 1-11.

Zhao et al., "Expanding RNA binding specificity and affinity of engineered PUF domains". Nucleic acids research. May 18, 2018; 46(9): 4771-82.

Kobatake et al., "Design and gene engineering synthesis of an extremely thermostable protein with biological activity". Biomacromolecules. Sep. 12, 2000;1(3):382-6.

Lao et al., "Affinity purification of plasmid DNA by temperature-triggered precipitation". Nature protocols. May 1, 2007;2(5):1263-8.

McDaniel et al., "A unified model for de novo design of elastin-like polypeptides with tunable inverse transition temperatures," Biomacromolecules, Aug. 2013, 14(8):2866-2872.

Sheth et al., "Affinity precipitation of a monoclonal antibody from an industrial harvest feedstock using an ELPZ stimuli responsive biopolymer". Biotechnology and bioengineering. Aug. 2014;111(8):1595-603.

UniProtKB Accession No. A0A2K5RXM_CEBIM. "Gene Ontology". UniProt Blast, [Online Database] (Mar. 28, 2018); last updated

(56) References Cited

OTHER PUBLICATIONS

[Oct. 15, 2025]. [Retrieved from Internet on Nov. 10, 2025 at https://www.uniprot.org/uniprotkb/A0A2K5RXA1/entry]; 7 pages.

Wang et al., "Non-chromatographic purification of thermostable endoglucanase from Thermotoga maritima by fusion with a hydro-phobic elastin-like polypeptide". Protein Expr Purif. Sep. 2020;173: 8 pages.

Zhou et al., "Multifunctional elastin-like polypeptide renders -glucosidase enzyme phase transition and high stability". Biotechnology for Biofuels. Jun. 24, 2019;12(1): 14 pages.

Chen et al., "Quick purification of recombinant adeno-associated viruses with the receptor-binding capture". Acta Microbiologica Sinica, Mar. 4, 2021;61(3):621-30.

Hahn et al., "Rapid manufacture and release of a GMP batch of avian influenza A (H7N9) virus-like particle vaccine made using recombinant baculovirus-Sf9 insect cell culture technology". BioProcessing. Jul. 2013;12(2):1538-8786.

Heidari-Japelagh et al., "Elastin-like polypeptide fusions for high-level expression and purification of human IFN-γ in *Escherichia coli*". Analytical Biochemistry. Nov. 15, 2019;585: 11 pages.

Kaldis et al., "High-level production of human interleukin-10 fusions in tobacco cell suspension cultures". Plant biotechnology journal. Jun. 2013;11(5):535-45.

Kosobokova et al., "Overview of fusion tags for recombinant proteins". Biochemistry (Moscow). Mar. 2016;81(3):187-200.

PCT Application No. PCT/US2024/043621, International Preliminary Report on Patentability mailed Mar. 5, 2026, Applicant Donaldson Company, Inc et al.; 8 pages.

Yu et al., "Synthetic fusion protein design and applications". Biotechnology advances. Jan. 1, 2015;33(1):155-64.

250
150
100
75
50
37

Benzonase

Silver-stained SDS-PAGE
gel has no visible impurities in elution fraction (2)

1 = cellular supernatant
2 = purified AAV

B1 Western blot confirms presence of capsid proteins in elution and depletion in capture supernatant VP1 87kDa VP2 72kDa VP3 62kDa CCH = cellular supernatant Capture Sup = supernatant after purification matrix applied Elution = purified AAV

PROTEIN-BASED PURIFICATION MATRICES AND METHODS OF USING THE SAME

CROSS-REFERENCE TO RELATED APPLICATIONS

This application is a continuation of U.S. application Ser. No. 17/493,938, filed Oct. 5, 2021, which is a continuation of International Patent Application No. PCT/US2021/018805, filed Feb. 19, 2021, which claims the benefit of priority to U.S. Provisional Application No. 62/978,615, filed Feb. 19, 2020, the contents of which are incorporated by reference herein in their entirety.

REFERENCE TO AN ELECTRONIC SEQUENCE LISTING

The contents of the electronic sequence listing (ISOL_002_03US_SeqList_ST26.xml; Size: 2,479,551 bytes; and Date of Creation: Jan. 23, 2023) are herein incorporated by reference in its entirety.

FIELD

The present disclosure is generally related to compositions and methods for purification of biologics. More specifically, the present disclosure relates to protein-based purification matrices, and methods of using the same.

BACKGROUND

The use of biologics in medicine and other disciplines is rapidly increasing. Biologics often have high affinity and specificity for a given target, as well as low toxicity and biodegradability. However, their manufacturing and purification can be quite difficult. Biologics, including therapeutic enzymes, antibodies, gene delivery vectors, and other fusion proteins, are typically manufactured recombinantly in bacteria, yeast, or mammalian host cells. Numerous downstream purification steps are then required in order to meet acceptable standards of purity (e.g., standards set by the FDA or other regulatory bodies). Host cell proteins, nucleic acids, endotoxins, and viruses are often the main contaminants that must be removed from biologic preparations.

One commonly used method of purification is affinity chromatography. For example, during antibody manufacture, affinity capture with Protein A chromatography is often the first step after clarification of the cell culture harvest. While affinity chromatography achieves high levels of purity (>90%) due to its selectivity for the target biologic, it is expensive, time consuming, and requires technical equipment that is expensive to maintain and requires skilled labor. It is also difficult to scale because conditions are not linear as column diameters become large.

There is a need in the art for improved compositions and methods for rapidly and cost-effectively purifying biologics.

SUMMARY

The present disclosure provides protein-based purification matrices for purifying biologics, and methods for using the same.

In some embodiments, the disclosure provides a method for purifying a biologic, the method comprising contacting the biologic with a protein-based purification matrix; wherein the biologic binds to the purification matrix to form a complex; wherein the size of the complex is increased by a first environmental factor; wherein the complex is separated from at least one contaminant on the basis of size; and wherein the biologic is separated from the purification matrix by a second environmental factor.

In some embodiments, the disclosure provides a method for removing a contaminant from a composition comprising a biologic, the method comprising contacting the contaminant with a protein-based purification matrix; wherein the contaminant binds to the matrix to form a complex; wherein the size of the complex is increased by a first environmental factor; wherein the complex is separated from the biologic on the basis of size; and wherein the contaminant is separated from the matrix by a second environmental factor.

In some embodiments, the disclosure provides a method for purifying a biologic, the method comprising contacting the biologic with a protein-based purification matrix; wherein the biologic binds to the matrix to form a complex; wherein the size of the complex is increased; wherein the complex is separated from at least one contaminant on the basis of size; and wherein the biologic is separated from the matrix by an environmental factor.

In some embodiments, the disclosure provides a method for separating a first biologic from a second biologic, the method comprising contacting the first biologic with a first protein-based purification matrix and contacting the second biologic with a second protein-based purification matrix; wherein the first biologic binds to the first purification matrix to form a first complex; wherein the second biologic binds to the second purification matrix to form a second complex; and separating the first biologic from the second biologic by applying an environmental factor.

In some embodiments, the disclosure provides a method of bringing a first biologic into proximity with a second biologic, the method comprising contacting the first biologic with a first protein-based purification matrix and contacting the second biologic with a second protein-based purification matrix; wherein the first biologic binds to the first purification matrix to form a first complex; wherein the second biologic binds to the second purification matrix to form a second complex; and wherein an environmental factor brings the first complex and the second complex into proximity with one another.

In some embodiments, the purification matrices described herein comprise (i) a capture domain which binds to the biologic, and (ii) a polypeptide with phase behavior, wherein the capture domain is coupled to the polypeptide with phase behavior. In some embodiments, the purification matrices comprise (i) a capture domain which binds to the contaminant, and (ii) a polypeptide with phase behavior, wherein the capture domain is coupled to the polypeptide with phase behavior.

In some embodiments, the capture domain is coupled to the polypeptide with phase behavior via a linker. In some embodiments, the linker is a peptide linker. In some embodiments, the peptide linker comprises a protease cleavage site. In some embodiments, the linker is a chemical linker.

In some embodiments, the purification matrix comprises a fusion protein comprising (i) a capture domain which binds to the biologic and (ii) a polypeptide with phase behavior. In some embodiments, the purification matrix comprises a fusion protein comprising (i) a capture domain which binds to the contaminant and (ii) a polypeptide with phase behavior.

In some embodiments, the polypeptide with phase behavior is a resilin-like polypeptide.

In some embodiments, the polypeptide with phase behavior is an elastin-like polypeptide.

In some embodiments, the polypeptide with phase behavior is a polymer containing a pentapeptide repeat having the sequence (Val-Pro-Gly-Xaa-Gly) n (SEQ ID NO: 10), or a randomized, scrambled analog thereof; wherein Xaa can be any amino acid except proline. In some embodiments, n is an integer from 1 to 360, inclusive of endpoints.

In some embodiments, the polypeptide with phase behavior comprises an amino acid sequence selected from: $(GRGDSPY)_n$ (SEQ ID NO: 1); $(GRGDSPH)_n$ (SEQ ID NO: 2); $(GRGDSPV)_n$ (SEQ ID NO: 3); $(GRGDSPYG)_n$ (SEQ ID NO: 4); $(RPLGYDS)_n$ (SEQ ID NO: 5); $(RPAGYDS)_n$ (SEQ ID NO: 6); $(GRGDSYP)_n$ (SEQ ID NO: 7); $(GRGDSPYQ)_n$ (SEQ ID NO: 8); $(GRGNSPYG)_n$ (SEQ ID NO: 9); $(GVGVP)_n$ (SEQ ID NO: 11); $(GVGVPGLGVPGVGVPGLGVPGVGVP)_m$ (SEQ ID NO: 12); $(GVGVPGVGVPGAGVPGVGVPGVGVP)_m$ (SEQ ID NO: 13); $(GVGVPGWGVPGVGVPGWGVPGVGVP)_m$ (SEQ ID NO: 14); $(GVGVPGVGVPGVGVPGVGVPGVGVPGVGVPGEGVPGFGVPGVGVP)_m$ (SEQ ID NO: 15); $(GVGVPGVGVPGVGVPGVGVPGVGVPGKGVPGFGVPGVGVP)_m$ (SEQ ID NO: 16); and $(GAGVPGVGVPGAGVPGVGVPGAGVP)_m$ (SEQ ID NO: 17); or a randomized, scrambled analog thereof; wherein: n is 20-360; and m is 4-25. In some embodiments, the he polypeptide with phase behavior comprises an amino acid sequence selected from: $(GVGVP)_m$ (SEQ ID NO: 52); $(ZZPXXXXGZ)_m$ (SEQ ID NO: 57); $(ZZPXGZ)_m$ (SEQ ID NO: 58); $(ZZPXXGZ)_m$ (SEQ ID NO: 59); or $(ZZPXXXGZ)_m$ (SEQ ID NO: 60); wherein m is an integer between 10 and 160, inclusive of endpoints, wherein X if present is any amino acid except proline or glycine, and wherein Z if present is any amino acid. In some embodiments, the polypeptide with phase behavior comprises an amino acid sequence of NO: 53) or $(GVGVPGVGVPGAGVPGVGVPGVGVP)_m$ (SEQ ID (GVGVPGVGVPGLGVPGVGVPGVGVP)_m$ (SEQ ID NO: 55); wherein m is an integer between 2 and 32, inclusive of endpoints. In some embodiments, the polypeptide with phase behavior comprises an amino acid sequence selected from: $(GVGVPGVGVPGAGVPGVGVPGVGVP)_m$ (SEQ ID NO: 193), wherein m is 8 or 16; $(GVGVPGAGVP)_m$ (SEQ ID NO: 54), wherein m is an integer between 5 and 80, inclusive of endpoints; or $(GXGVP)_m$ (SEQ ID NO: 56), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

In some embodiments, the capture domain comprises the sequence of any one of SEQ ID NO: 24-49, 62-148, and 167-171, or a sequence having at least 1, at least 2, at least 3, at least 4, or at least 5 mutations relative thereto.

In some embodiments, the binding of a biologic to the purification matrix is reversible. In some embodiments, the binding of a biologic to the purification matrix is non-covalent. In some embodiments, the binding of a biologic to the purification matrix is covalent.

In some embodiments, the binding of a contaminant to the purification matrix is reversible. In some embodiments, the binding of a contaminant to the purification matrix is non-covalent. In some embodiments, the binding of a contaminant to the purification matrix is covalent.

In some embodiments, the biologic is a lipid, a lipopolysaccharide, a cell, a protein, a nucleic acid, a carbohydrate, or a virus.

In some embodiments, the biologic is a cell. In some embodiments, the cell is a bacterial cell, a yeast cell, or a mammalian cell. In some embodiments, the cell is a stem cell, a bone cell, a blood cell, a muscle cell, a fat cell, a skin cell, a nerve cell, an endothelial cell, a sex cell, a pancreatic cell, or a cancer cell. In some embodiments, the cell is an immune cell. In some embodiments, the immune cell is a T cell, a B cell, a NK cell, a peripheral blood mononuclear cell, or a neutrophil. In some embodiments, the cell is a T cell expressing a chimeric antigen receptor (CAR).

In some embodiments, the nucleic acid is a DNA or an RNA.

In some embodiments, the virus is an adenovirus, an adeno-associated virus (AAV), a lentivirus, a retrovirus, a poxvirus or a herpesvirus.

In some embodiments, the biologic has a diameter between 1 nm and 100 μm, inclusive of the endpoints. In some embodiments, the biologic has a diameter between 1 nm and 100 nm, inclusive of the endpoints. In some embodiments, the biologic has a diameter between 100 nm and 1 μm, inclusive of the endpoints. In some embodiments, the biologic has a diameter between 1 μm and 50 μm, inclusive of the endpoints. In some embodiments, the biologic has a diameter between 50 μm and 100 μm, inclusive of the endpoints.

In some embodiments, the methods of the disclosure are completed in about 0.5 hours to about 24 hours. In some embodiments, the methods of the disclosure are completed in about 0.5 hours to about 8 hours. In some embodiments, the methods of the disclosure are completed in about 2 hours to about 6 hours.

In some embodiments, the separation of the complex from the at least one contaminant can be observed visually with an unaided eye.

In some embodiments, the increase in size of the complex is at least a 2-fold increase. In some embodiments, the increase in size of the complex is at least a 10-fold increase. In some embodiments, the increase in size of the complex is at least a 25-fold increase. In some embodiments, the increase in size is an increase in the mass of the complex. In some embodiments, the increase in size is an increase in the diameter of the complex.

In some embodiments, the environmental factor comprises one or more of: a change in one or more of temperature, pH, salt concentration, concentration of the purification matrix, concentration of the biologic, or pressure; the addition of one or more surfactants, molecular crowding agents, reducing agents, oxidizing agents, enzymes, or denaturing agents; or the application of electromagnetic or acoustic waves. In some embodiments, the environmental factor is the first and/or second environmental factor.

In some embodiments, the separation on the basis of size is performed using tangential flow filtration, membrane chromatography, analytical ultracentrifugation, high performance liquid chromatography, membrane chromatography, and/or fast protein liquid chromatography.

In some embodiments, the contaminant is selected from a solvent, an endotoxin, a protein, a peptide, a nucleic acid, and a carbohydrate.

In some embodiments, the purification yield of the biologic is at least 70%, at least 80%, at least 90%, at least 95%, at least 96%, at least 97%, at least 98%, or at least 99%. In some embodiments, the biologic is purified to at least 70%, at least 80%, at least 90%, at least 95%, at least 96%, at least 97%, at least 98%, or at least 99% purity.

In some embodiments, provided herein is a method of increasing yield of a biologic during production thereof, the method comprising culturing biologic-producing cells in the presence of a purification matrix. In some embodiments, the biologic reversibly binds to the purification matrix to form a complex. In some embodiments, the purification matrix is present at a concentration of at least about 10 μM.

In some embodiments, provided herein is a method of stabilizing a biologic during production thereof, the method comprising culturing biologic-producing cells in the presence of a purification matrix. In some embodiments, the biologic reversibly binds to the purification matrix to form a complex. In some embodiments, the purification matrix is present at a concentration of at least about 10 μM.

In some embodiments, provided herein is a method of stabilizing a biologic during purification thereof, the method comprising contacting the biologic with a purification matrix during purification thereof. In some embodiments, the biologic reversibly binds to the purification matrix to form a complex. In some embodiments, the purification matrix is present at a concentration of at least about 10 μM.

In some embodiments, provided herein is a method of stabilizing a biologic during storage thereof, the method comprising storing the biologic in the presence of a purification matrix.

In some embodiments, provided herein is a method of increasing the shelf-life of a biologic, the method comprising storing the biologic in the presence of a purification matrix. In some embodiments, the biologic reversibly binds to the purification matrix to form a complex. In some embodiments, the purification matrix is present at a concentration of at least about 10 μM.

These and other embodiments will be further described below in the Detailed Description, Examples, and Claims.

BRIEF DESCRIPTION OF THE DRAWINGS

FIG. 11 is a graph showing the effect of purification matrix concentration on the Capture Efficiency of AAV8 particles. The Capture Efficiency was calculated using the following equation: 100×(#of AAV8 particles captured by the purification matrix/#of AAV8 particles in the composition before purification).

Figure 12:
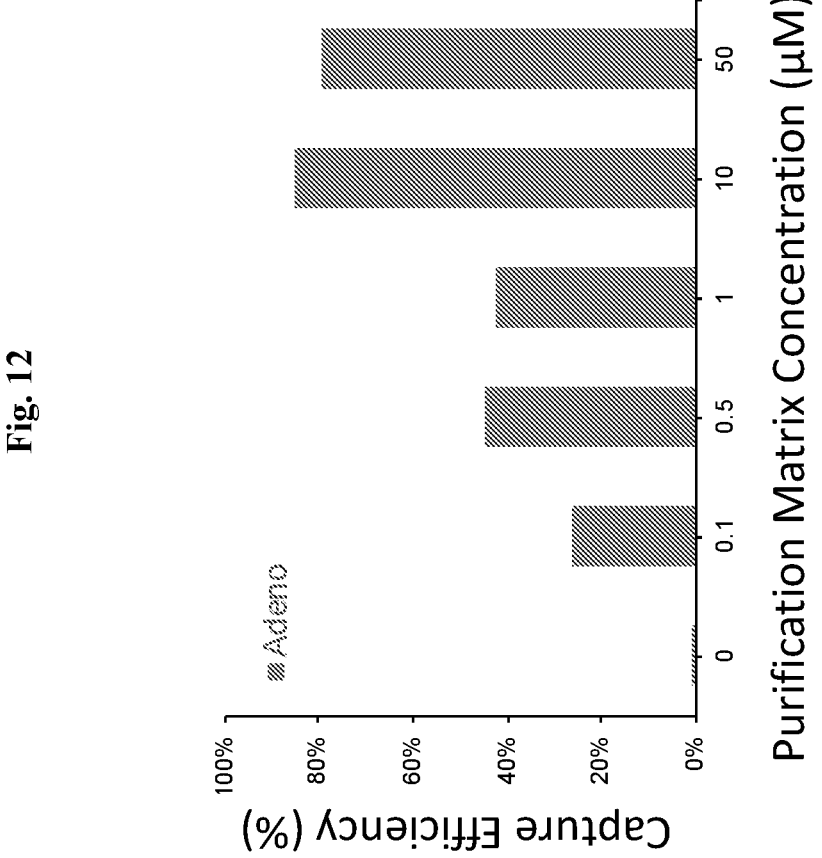

FIG. 12 is a graph showing the effect of purification matrix concentration on the Capture Efficiency of Ad5 particles. The Capture Efficiency was calculated using the following equation: 100×(#of Ad5 particles captured by the purification matrix/#of Ad5 particles in the composition before purification).

Figure 13:
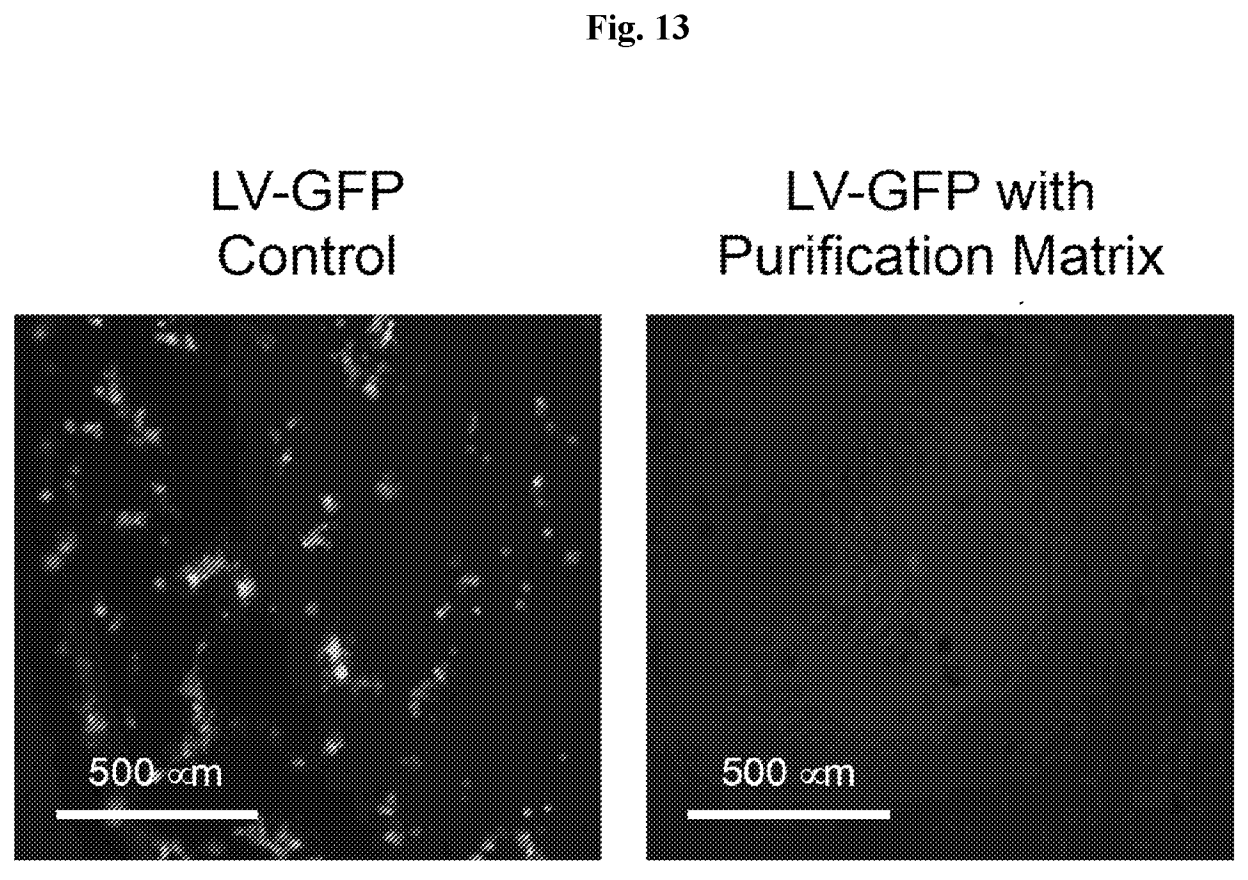

FIG. 13 shows fluorescent images of HEK293 cells incubated with the supernatant of a composition comprising lentivirus particles and phosphate-buffered saline (PBS), labeled LV-GFP control (left) or HEK293 cells incubated with the supernatant of a composition comprising lentivirus particles and purification matrix, labeled LV-GFP with Purification Matrix (right).

Figure 14:
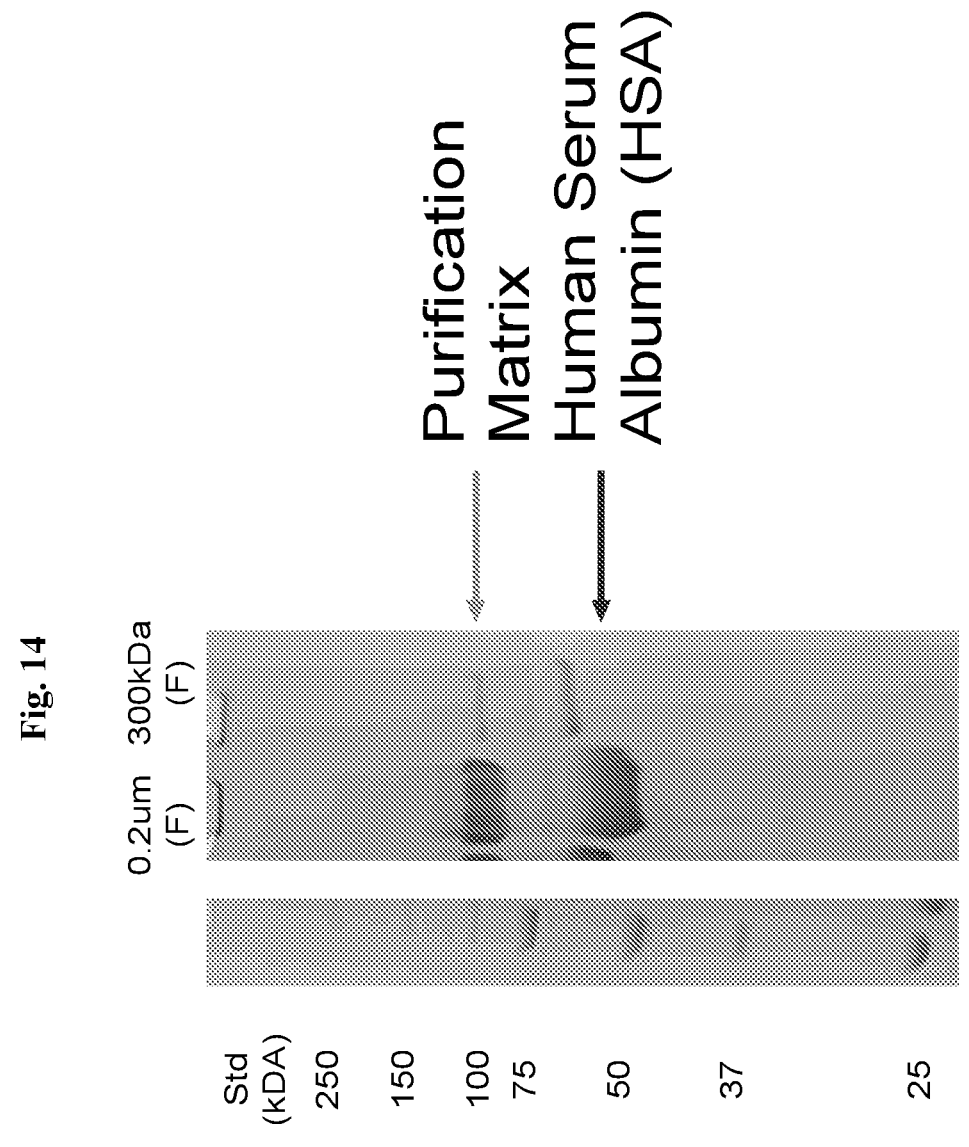

FIG. 14 shows an image of an SDS-PAGE gel. The first lane, labeled "0.2 um (F)", contains the filtrate of a complex between human serum albumin (HSA) and purification matrix after introduction of an environmental factor (0.6 M NaCl) that is applied to a filter with a 0.2 μm pore size. The second lane, labeled "300 kDa (F)", contains the filtrate of a complex between human serum albumin (HSA) and purification matrix after introduction of an environmental factor (0.6 M NaCl) that is applied to a filter with a 300 kDa molecular weight cutoff.

Figure 15:
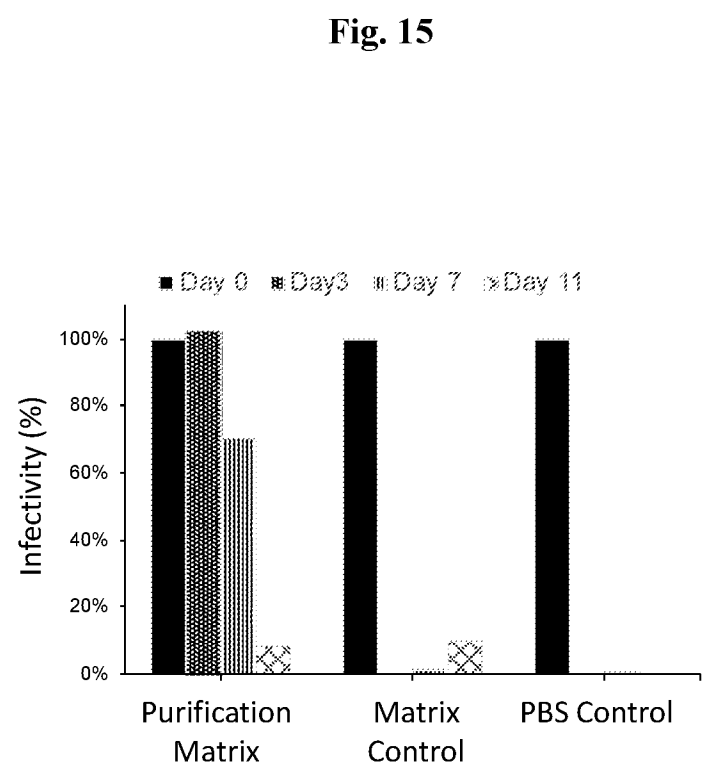

FIG. 15 is a graph showing the ability of Ad5 particles to infect HEK293 cells ("infectivity") 0, 3, 7, 11 days after incubation with purification matrix, matrix control, and PBS (labeled PBS control).

Figure 16:
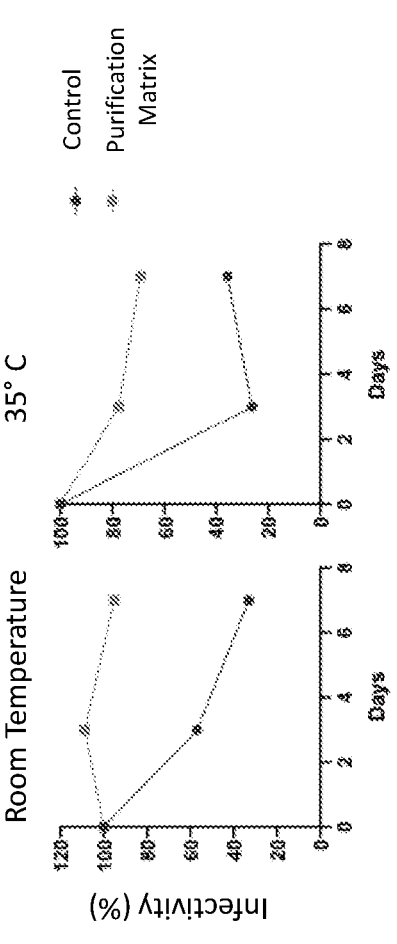

FIG. 16 is a graph showing the ability of Ad5 particles to infect HEK293 cells ("infectivity") incubated with purification matrix or PBS (labeled control) at room temperature (about 25° C.) or 35° C.

Figure 17:
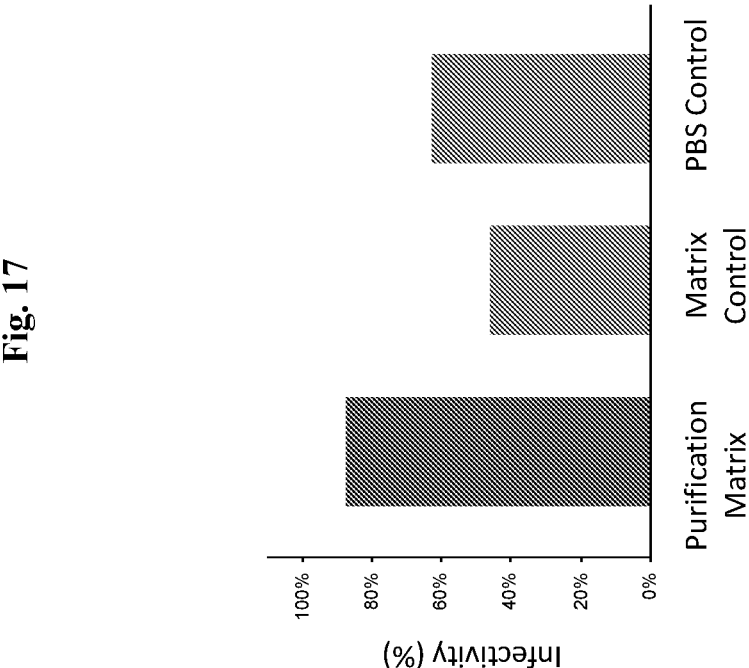

FIG. 17 is a graph showing the ability of Ad5 particles to infect HEK293 cells ("infectivity") incubated with purification matrix, matrix control, or PBS (labeled control) after three freeze-thaw cycles (−80° C. to room temperature).

Figure 18:
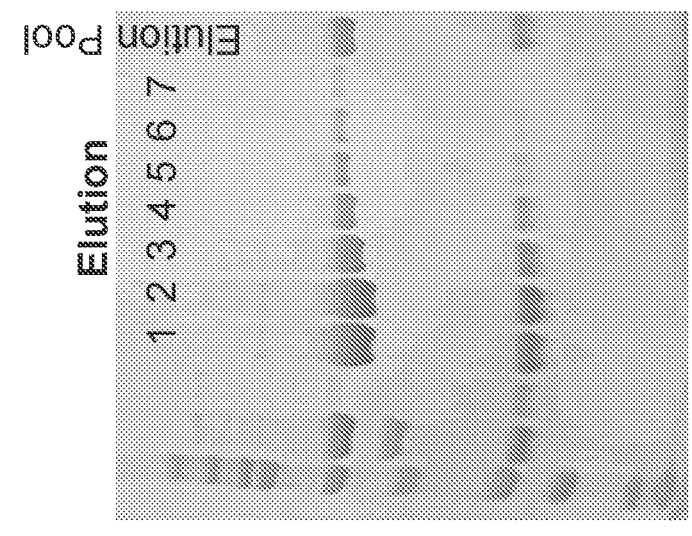
Figure 18:
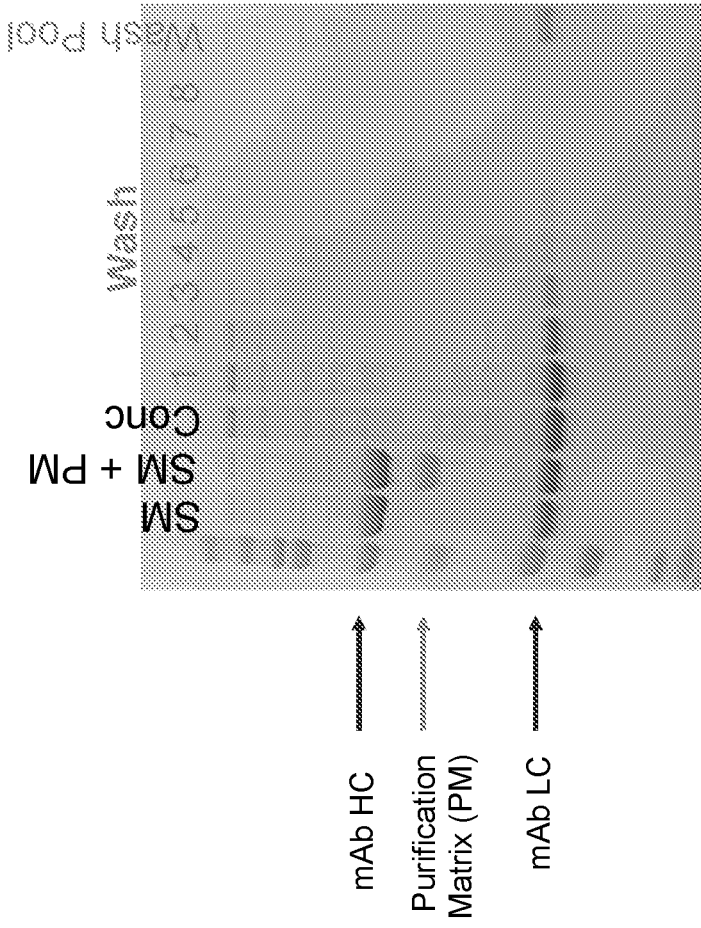

FIG. 18 is an image of SDS-PAGE gels that reveals the presence of IgG1 during tangential flow filtration (TFF) concentration (left), diafiltration (left), and elution (right). The composition containing supernatant of CHO cells expressing IgG1 is referred to as "SM" or starting material. The SM is concentrated via TFF ("Conc") and incubated with purification matrix "SM+PM" to form a complex. During diafiltration, the complexes are washed with 0.6 M NaCl (labeled "1"-"8") to remove impurities. The twelfth lane of the SDS-PAGE gel, labeled "wash pool" is a sample from a pool of the wash fractions. IgG1 is eluted from the complex with an elution buffer containing 50 mM sodium citrate, 0.6 M NaCl at a pH of 3. The SDS-PAGE gel on the right shows elution fractions, labeled "1" to "7" and a pool of the elution fractions labeled "elution pool."

Figure 19:
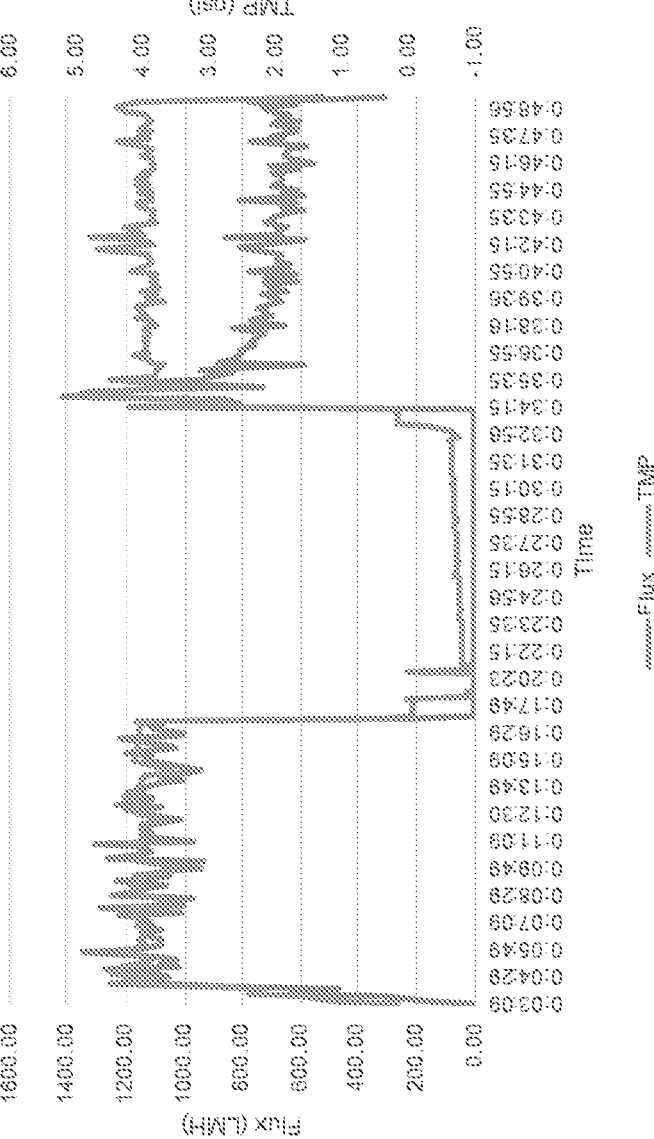

FIG. 19 shows the flux and transmembrane pressure (TMP) throughout tangential flow filtration (TFF) of a solution containing purification matrix and IgG1.

Figure 20:
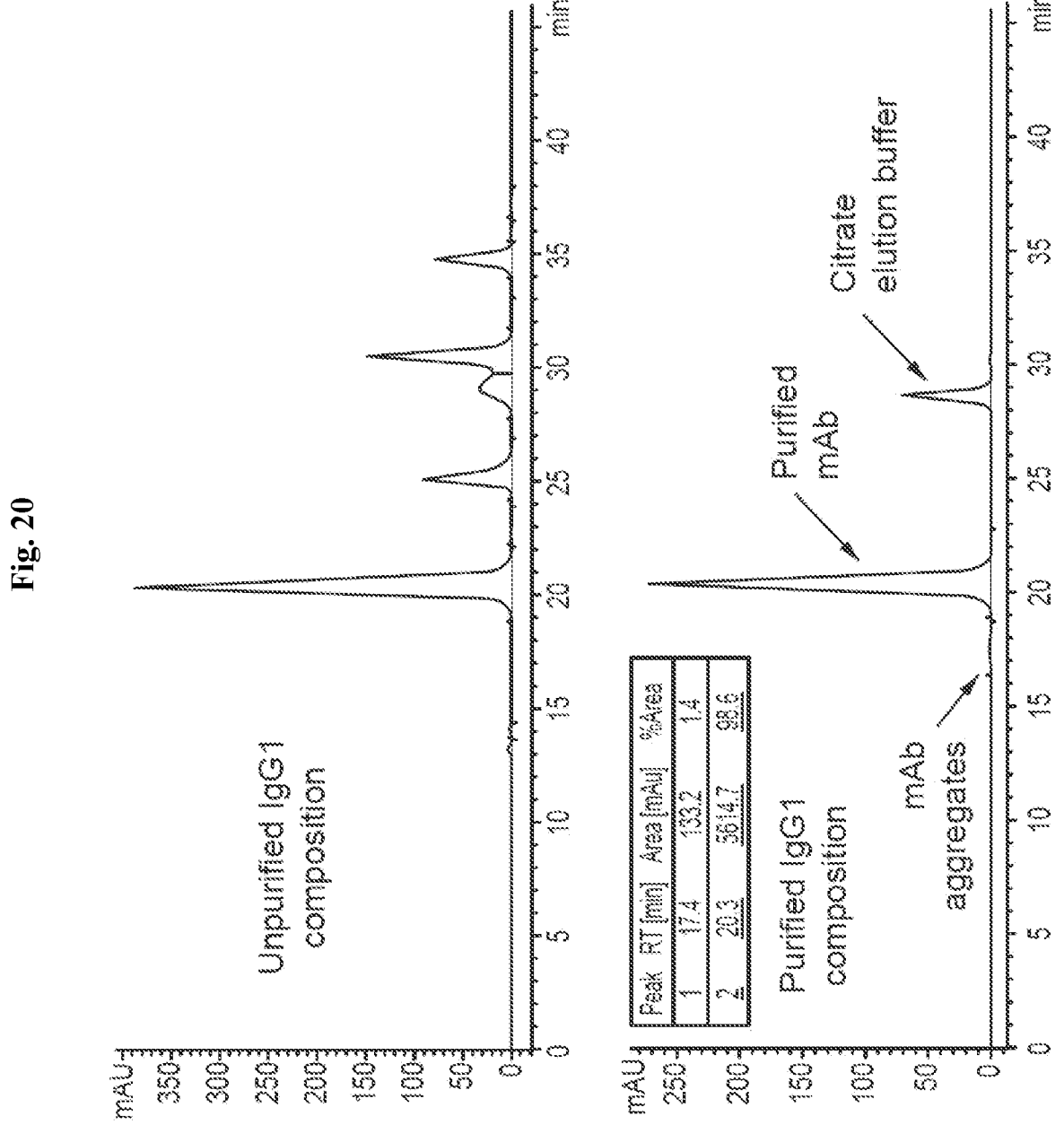

FIG. 20 shows a size exclusion chromatograph of a composition containing impure IgG1 (top) and of the pure IgG1 composition after purification via a purification matrix and tangential flow filtration (bottom).

Figure 21:
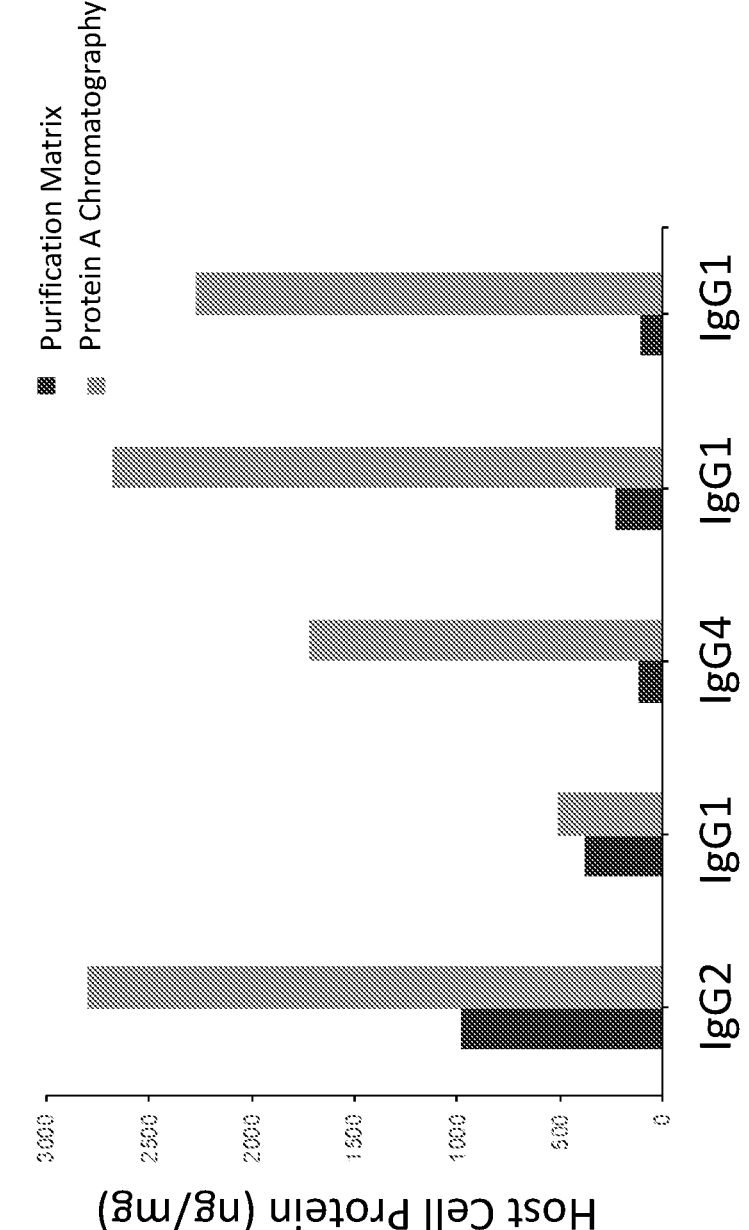

FIG. 21 shows host cell protein impurities in five different immunoglobulin compositions containing IgG2, IgG1, or IgG4 after purification using a purification matrix of the disclosure and tangential flow filtration as opposed to purification via protein A chromatography. Host cell protein impurities were quantitated by ELISA.

8

Figure 22:
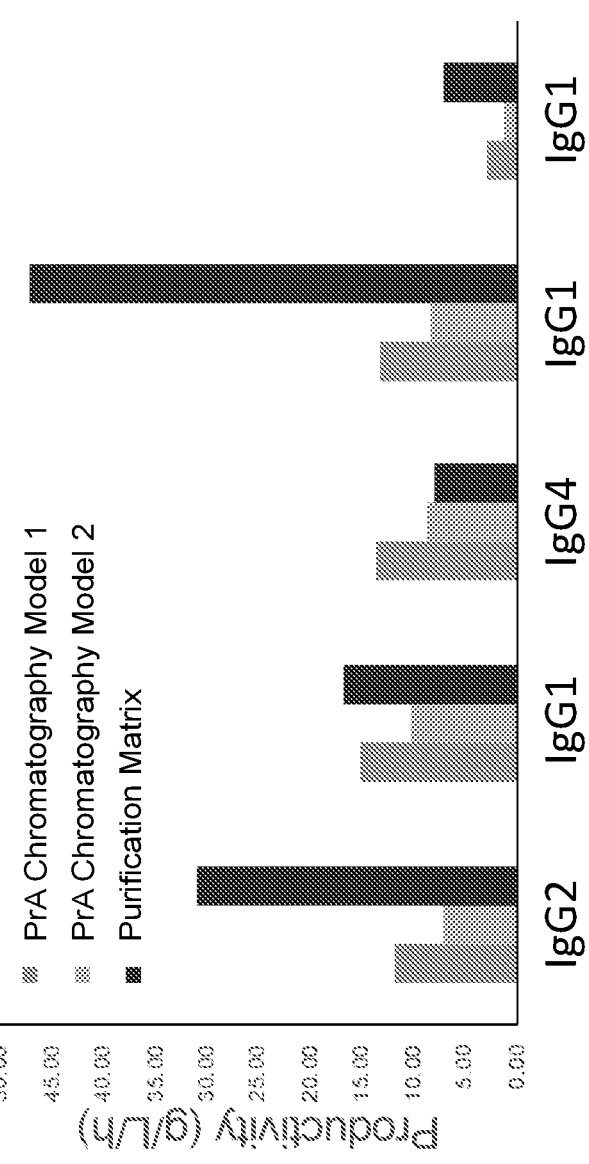

FIG. 22 shows the productivity of a purification matrix for purifying immunoglobulins as described herein, versus two different protein A resins (MabSelect SuRe™ LX and Amsphere™ A3) (labeled "PrA Chromatography Model 1" and "PrA Chromatography Model 2"). The productivity is calculated according to the following equation: amount of antibody purified (grams)/unit of material (Liters)/time (hours). The material refers to the volume of protein A resin or a purification matrix of the disclosure.

Figure 23:
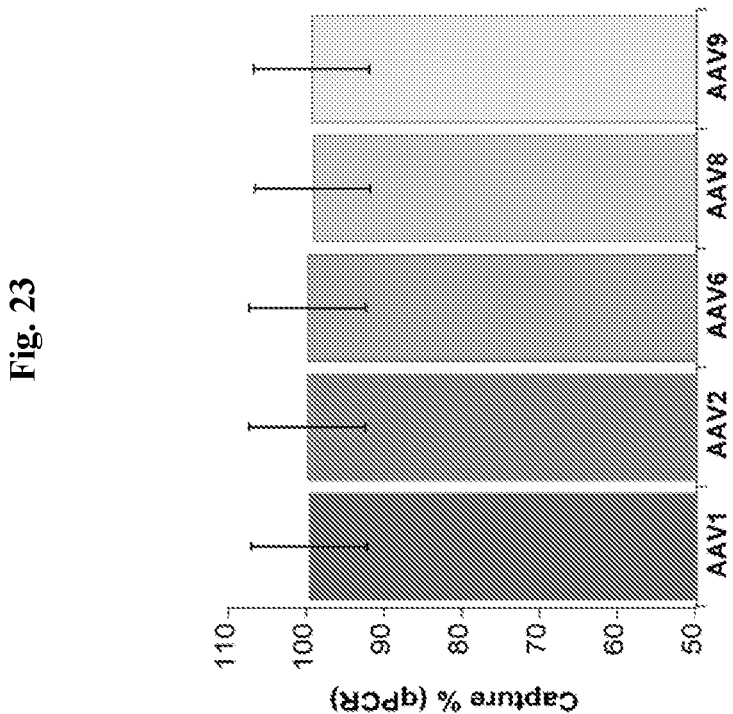

FIG. 23 shows the percentage of AAV particles captured from cellular supernatant using a purification matrix, as determined by quantitative polymerase chain reaction (qPCR).

Figure 24:
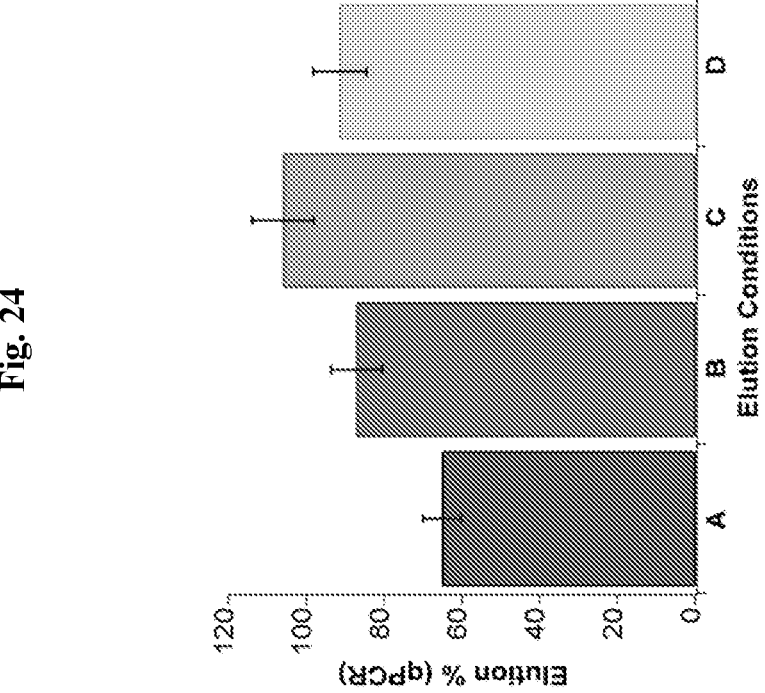

FIG. 24 shows the percentage of AAV particles eluted from the purification matrix, as determined by qPCR, using various elution conditions (e.g., second environmental factors).

Figure 25:
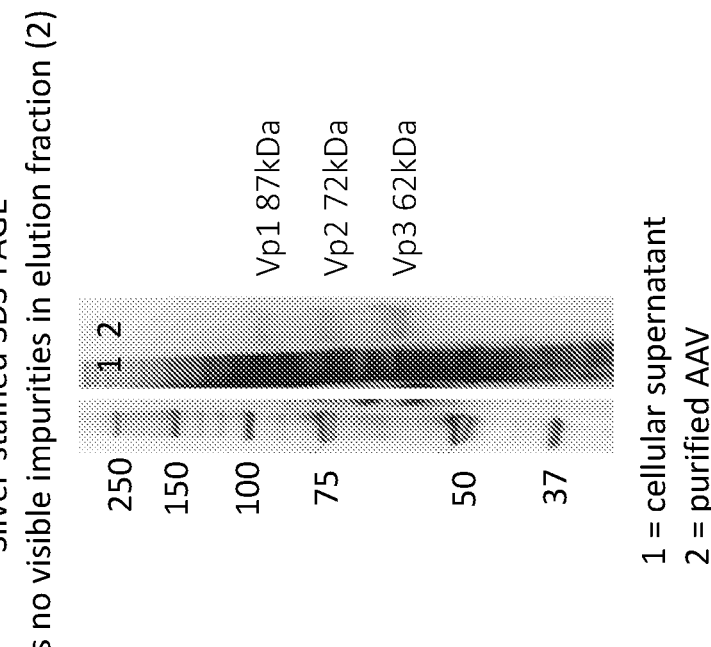

FIG. 25 provides an image of a silver-stained gel containing samples of (1) unpurified cellular supernatant, and (2) a sample comprising AAV particles purified according to the methods of the disclosure. In the sample containing AAV particles, bands for VP1, VP2, and VP3 proteins were observed at the expected sizes (i.e., 87 kDa, 72 kDa, and 62 kDa, respectively).

Figure 26:
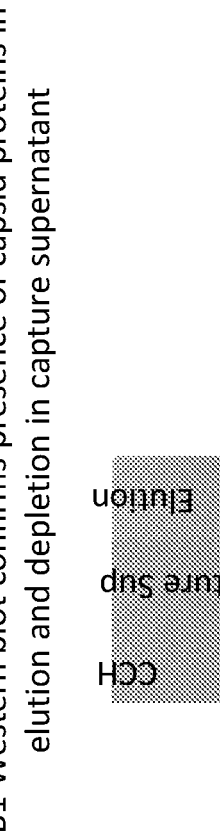
Figure 26:
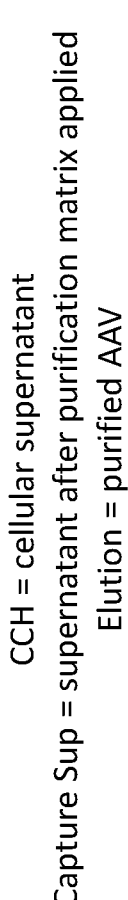

FIG. 26 provides an image of a Western Blot, showing that AAV VP1, VP2, and VP3 capsid proteins present in cellular supernatant were successfully captured and removed from the cellular supernatant using a purification matrix described herein.

Figure 27A:
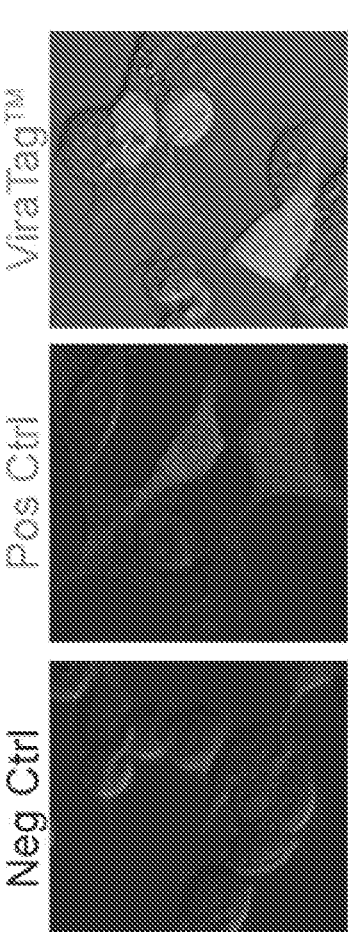

FIG. 27A shows pictures of cells infected with a control AAV particle (Pos Ctrl), or an AAV8 particle carrying a tdTomato transgene that was either (i) not purified by the methods of the disclosure (Pos Ctrl) or (ii) purified with a purification matrix of the disclosure (e.g. ViraTag™). Both control AAV and AAV purified with ViraTag™ are infectious. The image labeled "Neg Ctrl" shows cells which were not infected with any AAV particles.

Figure 27B:
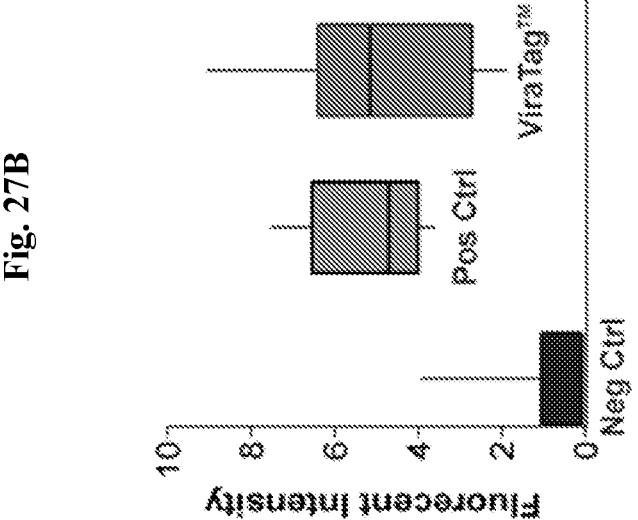

FIG. 27B shows the fluorescence intensity of cells infected with a control AAV particle (Pos Ctrl) or an AAV particle purified using a purification matrix as described herein (e.g. ViraTag™). Both types of AAV particles tested carried a tdTomato transgene.

DETAILED DESCRIPTION OF THE INVENTION

Definitions

As used herein, and in the appended claims, the singular forms "a", "an", and "the" include plural referents unless the context clearly dictates otherwise. Thus, for example, reference to "a protein" can refer to one protein or to mixtures of such protein, and reference to "the method" includes reference to equivalent steps and/or methods known to those skilled in the art, and so forth.

As used herein, the term "about" or "approximately" when preceding a numerical value indicates the value plus or minus a range of 10%. For example, "about 100" encompasses 90 and 110.

Also as used herein, "and/or" refers to and encompasses any and all possible combinations of one or more of the associated listed items, as well as the lack of combinations when interpreted in the alternative ("or").

Unless the context indicates otherwise, it is specifically intended that the various features described herein can be used in any combination.

Moreover, the present disclosure also contemplates that in some embodiments, any feature or combination of features set forth herein can be excluded or omitted. To illustrate further, if, for example, the specification indicates that a particular amino acid can be selected from A, G, I, L and/or V, this language also indicates that the amino acid can be selected from any subset of these amino acid(s) for example A, G, I or L; A, G, I or V; A or G; only L; etc., as if each such subcombination is expressly set forth herein. Moreover, such language also indicates that one or more of the specified amino acids can be disclaimed. For example, in particular embodiments the amino acid is not A, G or I; is not A; is not G or V; etc., as if each such possible disclaimer is expressly set forth herein.

As used herein, the term "protein-based" refers to a composition that comprises a protein or peptide component. For example, a protein-based purification matrix is a purification matrix that comprises a protein or peptide.

As used herein, the term "environmental factor" is any factor that, when applied to a composition comprising a protein-based purification matrix, alters one or more properties of the composition. Non-limiting examples of environmental factors include a change in one or more of temperature, pH, salt concentration, concentration of the purification matrix, concentration of the biologic, or pressure; the addition of one or more surfactants, molecular crowding agents, denaturing agents, reducing agents, or oxidizing agents; or the application of electromagnetic or acoustic waves.

As used herein, the term "biologic" may refer to, for example, a protein, a peptide, a carbohydrate, a nucleic acid, a virus, a cell (e.g., a bacterial, yeast, or mammalian cell), a carbohydrate, a lipid, or a lipopolysaccharide.

As used herein, the term "contaminant" may refer to any substance that is not desired in a purified composition. In some embodiments, the contaminant is any substance other than the biologic desired to be purified. Non-limiting examples of contaminants include, but are not limited to, a solvent, a protein, a peptide, a carbohydrate, a nucleic acid, a virus, a cell (e.g., a bacterial, yeast, or mammalian cell), a carbohydrate, a lipid, or a lipopolysaccharide. In some embodiments, the contaminant is an endotoxin or a mycotoxin.

An "adeno-associated virus" (AAV) is a small, replication-deficient parvovirus. As used herein, AAV may refer to a wildtype or mutant AAV of any one of the following serotypes: AAV1, AAV2, AAV3 (including types 3A and 3B), AAV4, AAV5, AAV6, AAV7, AAV8, AAV9, AAV10, AAV11, AAV12, AAV13, AAVrh32.33, AAVrh8, AAVrh10, AAVrh74, AAVhu.68, avian AAV, bovine AAV, canine AAV, equine AAV, ovine AAV, snake AAV, bearded dragon AAV, AAV218, AAV2g9, AAV-LK03, AAV7m8, AAV Anc80, AAV PHP.B, and any other AAV now known or later discovered. In some embodiments, an AAV may have a single-stranded genome, or a double-stranded genome (e.g., a self-complementary AAV). The "capsid" of an AAV particle is a near-spherical protein shell that comprises individual "capsid protein subunits" or "capsid proteins" (e.g., about 60 capsid protein subunits) associated and arranged with T=1 icosahedral symmetry. Accordingly, the capsids of the AAV vectors described herein comprise a plurality of capsid proteins. An "AAV particle" typically comprises a capsid, and a nucleic acid (e.g., a nucleic acid comprising a transgene) encapsidated by the protein capsid. When an AAV particle is described as comprising a capsid protein, it will be understood that the AAV particle comprises a capsid, wherein the capsid comprises one or more AAV capsid proteins. When an AAV particle is described as binding to a binding domain, it will be understood that the binding domain may bind to one or more capsid proteins within the capsid. The term "empty AAV particle" or "empty capsid" refers to an AAV particle or capsid that does not comprise any vector genome or nucleic acid comprising an expression cassette or transgene.

A "viral particle" typically comprises a protein shell (e.g., a capsid or an envelope), and a nucleic acid (e.g., a nucleic acid comprising a transgene) contained therein.

As used herein, the terms "peptide," "polypeptide," and "protein" are used interchangeably, and refer to a compound comprised of amino acid residues covalently linked by peptide bonds. A protein must contain at least two amino acids, and no limitation is placed on the maximum number of amino acids that can comprise a protein's sequence. The term "peptide" may refer to a short chain of amino acids including, for example, natural peptides, recombinant peptides, synthetic peptides, or a combination thereof. Proteins and peptides may include, for example, biologically active fragments, substantially homologous polypeptides, oligopeptides, homodimers, heterodimers, variants of polypeptides, modified polypeptides, derivatives, analogs, and fusion proteins, among others.

A "polynucleotide" is a sequence of nucleotide bases, and may be RNA, DNA or DNA-RNA hybrid sequences (including both naturally occurring and/or non-naturally occurring nucleotides). In some embodiments, a polynucleotide is either a single or double stranded DNA sequence.

As used herein, by "isolate" or "purify" (or grammatical equivalents) a biologic, it is meant that the biologic is at least partially separated from at least some of the other components in a starting material comprising the biologic (e.g., a cell lysate). In representative embodiments an "isolated" or "purified" biologic is enriched by at least about 10-fold, about 100-fold, about 1000-fold, about 10,000-fold or more as compared with the starting material.

As used herein, the term "polypeptide with phase behavior" refers to any polypeptide that is capable of undergoing a phase transition. In some embodiments, the polypeptide undergoes a phase transition due to the application of an environmental factor. Exemplary polypeptides with phase behavior include elastin-like polypeptides (ELPs) and resilin-like polypeptides (RLPs).

As used herein, the term "fusion protein" refers to a polypeptide produced when two heterologous nucleotide sequences or fragments thereof coding for two (or more) different polypeptides not found fused together in nature are fused together in the correct translational reading frame.

As used herein, the term "capture domain" may refer to any amino acid sequence (protein, peptide, etc.) which binds to a target biologic. In some embodiments, the capture domain may comprise a full-length, truncated, or modified version of a receptor for the target biologic. In some embodiments, the capture domain may be an antigen-binding portion of a monoclonal antibody (e.g., a Fab), a single-chain variable fragment (scFv) derived from a monoclonal antibody; a natural ligand of the target biologic; a peptide with sufficient affinity for the target; a single domain binder such as a camelid; an artificial binder such as a Darpin; or a single-chain derived from a T-cell receptor.

As used herein, the term "fragment" as it refers to a protein or polypeptide includes a truncated form of the protein or polypeptide. For example, a fragment of CD4 may include about 1%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 97%, or about 99% of the amino acids of full-length CD4.

As used herein, the term "capture efficiency" as it relates to a purification matrix described herein refers to the amount of biologic captured by a purification matrix relative to the amount of biologic present in the starting composition. The following equation is used to determine capture efficiency: 100×(amount of biologic captured by the purification matrix/amount of biologic in the composition before purification).

As used herein, the term "amino acid" encompasses any naturally occurring amino acid, modified forms thereof, and synthetic amino acids. Naturally occurring, levorotatory (L-) amino acids are shown in Table 1.

TABLE 1

Amino acid residues and abbreviations.

| Amino Acid Residue | Three-Letter Code | One-Letter Code |
|---|---|---|
| | Abbreviation | |
| Alanine | Ala | A |
| Arginine | Arg | R |
| Asparagine | Asn | N |
| Aspartic acid (Aspartate) | Asp | D |
| Cysteine | Cys | C |
| Glutamine | Gln | Q |
| Glutamic acid (Glutamate) | Glu | E |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

Alternatively, the amino acid can be a modified amino acid residue (nonlimiting examples are shown in Table 2) and/or can be an amino acid that is modified by post-translational modification (e.g., acetylation, amidation, formylation, hydroxylation, methylation, phosphorylation or sulfatation).

TABLE 2

Modified Amino Acid Residues.

| Modified Amino Acid Residue | Abbreviation |
|---|---|
| Amino Acid Residue Derivatives | |
| 2-Aminoadipic acid | Aad |
| 3-Aminoadipic acid | bAad |
| beta-Alanine, beta-Aminoproprionic acid | bAla |
| 2-Aminobutyric acid | Abu |
| 4-Aminobutyric acid, Piperidinic acid | 4Abu |
| 6-Aminocaproic acid | Acp |
| 2-Aminoheptanoic acid | Ahe |
| 2-Aminoisobutyric acid | Aib |
| 3-Aminoisobutyric acid | bAib |
| 2-Aminopimelic acid | Apm |
| t-butylalanine | t-BuA |
| Citrulline | Cit |
| Cyclohexylalanine | Cha |
| 2,4-Diaminobutyric acid | Dbu |
| Desmosine | Des |

TABLE 2-continued

Modified Amino Acid Residues.

| Modified Amino Acid Residue | Abbreviation |
|---|---|
| 2,21-Diaminopimelic acid | Dpm |
| 2,3-Diaminoproprionic acid | Dpr |
| N-Ethylglycine | EtGly |
| N-Ethylasparagine | EtAsn |
| Homoarginine | hArg |
| Homocysteine | hCys |
| Homoserine | hSer |
| Hydroxylysine | Hyl |
| Allo-Hydroxylysine | aHyl |
| 3-Hydroxyproline | 3Hyp |
| 4-Hydroxyproline | 4Hyp |
| Isodesmosine | Ide |
| allo-Isoleucine | alle |
| Methionine sulfoxide | MSO |
| N-Methylglycine, sarcosine | MeGly |
| N-Methyl isoleucine | MeIle |
| 6-N-Methyllysine | MeLys |
| N-Methylvaline | MeVal |
| 2-Naphthylalanine | 2-Nal |
| Norvaline | Nva |
| Norleucine | Nle |
| Ornithine | Orn |
| 4-Chlorophenylalanine | Phe(4-C1) |
| 2-Fluorophenylalanine | Phe(2-F) |
| 3-Fluorophenylalanine | Phe(3-F) |
| 4-Fluorophenylalanine | Phe(4-F) |
| Phenylglycine | Phg |
| Beta-2-thienylalanine | Thi |

Further, the non-naturally occurring amino acid can be an "unnatural" amino acid (as described by Wang et al., Annu Rev Biophys Biomol Struct. 35:225-49 (2006)).

Methods of Using Protein-Based Purification Matrices

The disclosure provides protein-based purification matrices and methods of using the same. In some embodiments, the protein-based purification matrices comprise a capture domain which binds to a target and a polypeptide with phase behavior, wherein the capture domain is coupled to the polypeptide with phase behavior. Non-limiting examples of targets include biologics and contaminants.

In some embodiments, a method of purifying a biologic comprises contacting the biologic with a protein-based purification matrix; wherein the biologic binds to the purification matrix to form a complex; wherein the size of the complex is increased by a first environmental factor; wherein the complex is separated from at least one contaminant on the basis of size; and wherein the biologic is separated from the purification matrix by a second environmental factor.

In some embodiments, a method of purifying a biologic comprises contacting the biologic with a protein-based purification matrix; wherein the biologic binds to the matrix to form a complex; wherein the size of the complex is increased; wherein the complex is separated from at least one contaminant on the basis of size; and wherein the biologic is separated from the matrix by an environmental factor.

In some embodiments, a method of removing a contaminant from a composition comprising a biologic comprises contacting the contaminant with a protein-based purification matrix; wherein the contaminant binds to the matrix to form a complex; wherein the size of the complex is increased by a first environmental factor; wherein the complex is separated from the biologic on the basis of size; and wherein the contaminant is separated from the matrix by a second environmental factor.

In some embodiments, a method of separating a first biologic from a second biologic comprises contacting the first biologic with a first protein-based purification matrix and contacting the second biologic with a second protein-based purification matrix; wherein the first biologic binds to the first purification matrix to form a first complex; wherein the second biologic binds to the second purification matrix to form a second complex; and separating the first biologic from the second biologic by applying an environmental factor.

Also provided herein is a method of bringing a biologic in proximity to another biologic or small molecule. In some embodiments, a method of bringing a first biologic into proximity with a second biologic comprises contacting the first biologic with a first protein-based purification matrix and contacting the second biologic with a second protein-based purification matrix; wherein the first biologic binds to the first purification matrix to form a first complex; wherein the second biologic binds to the second purification matrix to form a second complex; and wherein an environmental factor brings the first complex and second complex into proximity with one another. In some embodiments, a method of bringing a first biologic into proximity with another molecule comprises contacting the first biologic with a first protein-based purification matrix and contacting the molecule with a second protein-based purification matrix; wherein the first biologic binds to the first purification matrix to form a first complex; wherein the molecule binds to the second purification matrix to form a second complex; and wherein an environmental factor brings the first complex and second complex into proximity with one another. In some embodiments, the methods described herein bring a first biologic and a second biologic within about 10 µm, about 5 µm, about 1 µm, about 900 nm, about 800 nm, about 700 nm, about 600 nm, about 500 nm, about 400 nm, about 300 nm, about 200 nm, about 100 nm, about 10 nm, about 1 nm, about 0.5 nm, or about 0.1 nm of one another. In some embodiments, a first biologic and a second biologic are brought into proximity with one another, wherein the first biologic is an enzyme and the second biologic is a substrate thereof.

In some embodiments, the methods described herein utilize a protein-based purification matrix comprising a capture domain and a polypeptide with phase behavior. In some embodiments, the methods described herein utilize two or more distinct protein-based purification matrices.

In some embodiments, the methods described herein involve the formation of a complex. In some embodiments, the methods described herein involve the formation of one or more complexes. In some embodiments, the methods described herein involve the formation of one, two, three, four, five, or more complexes. The complexes may be referred to as "first complex" or "second complex," and so on.

In some embodiments, a complex comprises a protein-based purification matrix and a biologic. In some embodiments, a complex comprises a protein-based purification matrix and a contaminant. In some embodiments, a complex comprises a protein-based purification matrix and a second protein such as an enzyme substrate, a metabolite, a ligand (e.g., a ligand that binds to a cellular receptor).

In some embodiments, the components of the complex (e.g. the purification matrix and the contaminant, biologic, and/or other molecule) bind to each other. In some embodiments, the binding is reversible. Reversible binding means that the complexes can dissociate e.g. separate into individual components. For example, if a complex reversibly forms between the purification matrix and a biologic, the purification matrix and the biologic can subsequently disassociate. In some embodiments, dissociation is triggered by an environmental factor. In some embodiments, reversible binding allows for separation of a biologic from the purification matrix. In some embodiments, reversible binding allows for separation of a contaminant from the purification matrix. In some embodiments, reversible binding allows for separation of the other molecule from the purification matrix.

In some embodiments, reversible binding is non-covalent, i.e. no covalent bonds are formed between the interacting components of the complex (such as between the purification matrix and the contaminant, biologic, and/or other molecule). In some embodiments, non-covalent interactions cause the purification matrix and the contaminant, biologic, and/or other molecule to bind to each other. Non-limiting examples of non-covalent interactions include dipole-dipole forces, van der Waals forces, London Dispersion forces, hydrogen bonding, hydrophobic interactions, and electrostatic interactions. In some embodiments, non-covalent binding is disrupted by the addition of an environmental factor.

In some embodiments, binding between the purification matrix and a target molecule (e.g., a contaminant, biologic, and/or other molecule) is covalent. In some embodiments, a covalent bond between a purification and a matrix may be cleaved using, for example, a protease.

In some embodiments, the size of the complexes described herein increase after an environmental factor is applied. In some embodiments, the size of a complex formed between the purification matrix and biologic, contaminant, and/or other molecule increases. In some embodiments, the size of the initial complex increases as a result of aggregation of multiple complexes. In some embodiments, multiple complexes aggregate due to self-assembly of protein-based purification matrices. In some embodiments, multiple complexes aggregate due to the application of an environmental factor. In some embodiments, the size increase is stabilized by non-covalent interactions between multiple protein-based purification matrix molecules. In some embodiments, the size increase is stabilized by non-covalent interactions between the polypeptides with phase behavior. In some embodiments, the non-covalent interactions are dipole-dipole forces, van der Waals forces, London Dispersion forces, hydrogen bonding, hydrophobic interactions, and/or electrostatic interactions.

In some embodiments, the methods of the disclosure provide for the formation of multiple complexes in a mixture. In some embodiments, the size of all of complexes increase. In some embodiments, the size of some complexes increases, and the size of the other complexes remains constant. In some embodiments, the size of one complex increases, and the size of the other complex remains constant.

In some embodiments, the size of the initial complex increases by at least about 2-fold, at least about 5-fold, at least about 10-fold, at least about 15-fold, at least about 20-fold, at least about 25-fold, at least about 30-fold, at least about 35-fold, at least about 40-fold, at least about 45-fold, at least about 50-fold, at least about 55-fold, at least about 60-fold, at least about 65-fold, at least about 70-fold, at least about 75-fold, at least about 80-fold, at least about 85-fold, at least about 90-fold, at least about 95-fold, at least about 100-fold, or more. In some embodiments, the size of the initial complex increases by at least about 2-fold. In some embodiments, the size of the initial complex increases by at least about 5-fold. In some embodiments, the size of the initial complex increases by at least about 10-fold. In some embodiments, the size of the initial complex increases by at least about 25-fold.

As used herein, the phrase "increase in size" may refer to an increase in the diameter of the complex or an increase in the mass of the complex. In some embodiments, the increase in size is an increase in the molar mass of the complex. In some embodiments, the increase in size is an increase in the hydrodynamic radius of the complex.

In some embodiments, the increase in size of the complex can be observed visually with an unaided eye. For example, the increase in size of the complex may cause a composition comprising the complex to change color, clarity, viscosity, and/or may cause the complex to change solubility (e.g., to precipitate from solution), wherein such change is observable by a human without the use of any special equipment.

In some embodiments, a person of skill in the art may measure the increase in the size of the complex according to known methods in the art. In some embodiments, the increase in the size of the complex can be measured utilizing a technique selected from the group consisting of x-ray scattering, small angle x-ray scattering, wide angle x-ray scattering, dynamic light scattering, analytical ultracentrifugation, size exclusion chromatography, and photon correlation spectroscopy.

In some embodiments, the complex of increased size is separated from a biologic, contaminant, and/or small molecule. In some embodiments, the complex of increased size containing a biologic and a protein-based purification matrix is separated from a contaminant. In some embodiments, the complex of increased size containing a contaminant and a protein-based purification matrix is separated from a composition containing a biologic. In some embodiments, the first complex of increased size containing a first biologic and a first protein-based purification matrix is separated from a second complex containing a second biologic and a second protein-based purification matrix.

In some embodiments, separation of the complex from the biologic, contaminant, and/or small molecule can be observed visually with an unaided eye.

In some embodiments, separation of the complex from the biologic, contaminant, and/or small molecule is on the basis of size. In some embodiments, the separation on the basis of size is performed using a technique selected from the group consisting of tangential flow filtration (TFF), analytical ultracentrifugation, membrane chromatography, high performance liquid chromatography, size exclusion chromatography, membrane chromatography, normal flow filtration, acoustic wave separation, centrifugation, counterflow centrifugation, and fast protein liquid chromatography. In some embodiments, the complex is separated from at least one impurity on the basis of size using tangential flow filtration. In some embodiments, the complex is separated from at least one impurity on the basis of size using centrifugation. In some embodiments, between about 100 relative centrifugal force (RCF) and about 16,000 RCF, for example, about 500 to about 16,000 RCF, about 1,000 RCF to 16,000 RCF, are applied to separate the complex from at least one impurity. In some embodiments, at least 500 relative centrifugal force (RCF) are applied to separate the complex from at least one impurity, for example, at least about 500 RCF, at least about 600 RCF, at least about 700 RCF, at least about 800 RCF, at least about 900 RCF, at least about 1000 RCF, at least about 2000 RCF, at least about 3000 RCF, at least about 3500 RCF, at least about 4000 RCF, at least about 5000 RCF, at least about 6000 RCF, at least about 7000 RCF, at least about 8000 RCF, at least about 9000 RCF, at least about 10,000

RCF, at least about 11,000 RCF, at least about 12,000 RCF, at least about 13,000 RCF, at least about 14,000 RCF, at least about 15,000 RCF, at least about 16,000 RCF, at least about 17,000 RCF, at least about 18,000 RCF, at least about 19,000 RCF, or at least about 20,000 RCF.

In some embodiments, separation of the complex from the biologic, contaminant, and/or small molecule on the basis of size is performed using TFF. In some embodiments, TFF may be used to separate the complex from at least one impurity on the basis of size, a process also referred to herein as "diafiltration." Diafiltration comprises both washing and elution steps. Washing removes impurities contained in the composition comprising the complexes. Elution separates purified biologics from the purification matrix. In some embodiments, the complexes are concentrated using TFF. In some embodiments, TFF may be used to increase the concentration of a complex within a composition, a process also referred to herein as "concentration."

Tangential flow filtration employs both microfiltration and ultrafiltration membranes to separate molecules. Microfiltration membranes typically have pore sizes between 0.1 μm and 10 μm. Ultrafiltration membranes typically have smaller pore sizes than microfiltration membranes with pore sizes between 0.001 μm and 0.1 μm. In some embodiments, a membrane with a pore size between about 0.001 μm and about 10 μm is utilized in the methods of the disclosure. In some embodiments, the membrane has a pore size of about 0.001 μm, about 0.01 μm, about 0.05 μm, about 0.1 μm, about 0.2 μm, about 0.3 μm, about 0.4 μm, about 0.5 μm, about 0.6 μm, about 0.7 μm, about 0.8 μm, about 0.9 μm, about 1.0 μm, about 2 μm, about 3 μm, about 4 μm, about 5 μm, about 6 μm, about 7 μm, about 8 μm, about 9 μm, or about 10 μm, including all values and ranges in between thereof. In some embodiments, the membrane has a pore size of about 0.1 μm. In some embodiments, the membrane has a pore size of about 0.2 μm.

In some embodiments, the membrane is made of hydrophilized poly (vinylildene difluoride) (PVDF), polyethersulfone (PES), cellulose phosphate, diethylaminoethyl cellulose, polysufone, regenerated cellulose, nylon, cellulose nitrate, cellulose acetate, pegylated PES, modified polyethersulfone, and sulfonated PES, or modified derivatives thereof of the aforementioned materials.

In TFF, a membrane is placed tangentially to the flow of a fluid mixture to cause the fluid mixture to flow tangentially over a first side of the membrane. At the same time, a fluid media is placed in contact with a second surface of the membrane. A transmembrane pressure is the force that drives fluid through the membrane, carrying along permeable molecules.

In some embodiments, separation of the complex from the biologic, contaminant, and/or small molecule on the basis of size is performed using TFF with a transmembrane pressure of between about 0.1 bar to about 3 bar. In some embodiments, the transmembrane pressure is about 0.1 bar, about 0.2 bar, about 0.3 bar, about 0.4 bar, about 0.5 bar, about 0.6 bar, about 0.7 bar, about 0.8 bar, about 0.9 bar, about 1.0 bar, about 1.1 bar, about 1.2 bar, about 1.3 bar, about 1.4 bar, about 1.5 bar, about 1.6 bar, about 1.7 bar, about 1.8 bar, about 1.9 bar, about 2.0 bar, about 2.1 bar, about 2.2 bar, about 2.3 bar, about 2.4 bar, about 2.5 bar, about 2.6 bar, about 2.7 bar, about 2.8 bar, about 2.9 bar, or about 3.0 bar, including all values and ranges in between. In some embodiments, the transmembrane pressure is about 1.5 bar.

In some embodiments, the cross flow rate is tuned to improve the separation of the complexes described herein from the biologic, contaminant, and/or small molecule. The cross flow rate is the rate of solution flow through the feed channel and across the membrane. It provides the force that sweeps away molecules that can restrict filtrate flow. In some embodiments, the cross flow rate is between about 500 $L/m^2/h$ and about 2000 $L/m^2/h$. In some embodiments, the cross flow rate is between about 500 $L/m^2/h$, about 600 $L/m^2/h$, about 700 $L/m^2/h$, about 800 $L/m^2/h$, about 900 $L/m^2/h$, about 1000 $L/m^2/h$, about 1100 $L/m^2/h$, about 1200 $L/m^2/h$, about 1300 $L/m^2/h$, about 1400 $L/m^2/h$, about 1500 $L/m^2/h$, about 1600 $L/m^2/h$, about 1700 $L/m^2/h$, about 1800 $L/m^2/h$, about 1900 $L/m^2/h$, or about 2000 $L/m^2/h$, including all values and ranges in between thereof. In some embodiments, the cross flow rate is about 960 $L/m^2/h$. In some embodiments, TFF separation occurs by using a membrane that retains the complex containing the purification matrix and the biologic while passing the contaminant. In some embodiments, a membrane that retains the complex containing the purification matrix and the contaminant while passing the biologic is used. In some embodiments, a membrane that retains the complex containing the purification matrix and the contaminant while passing the biologic is utilized. In some embodiments, a membrane that retains the first complex containing the purification matrix and the first biologic while passing the complex containing the second purification matrix and second biologic is utilized.

In some embodiments, the methods described herein enable the purification of at least 0.1 kg, at least about 0.2 kg, at least about 0.3 kg, at least about 0.4 kg, at least about 0.5 kg, at least about 0.6 kg, at least about 0.7 kg, at least about 0.8 kg, at least about 0.9 kg, at least about 1 kg, at least about 2 kg, at least about 3 kg, at least about 4 kg, at least about 5 kg, at least about 6 kg, at least about 7 kg, at least about 8 kg, at least about 9 kg, at least about 10 kg, or more of biologic per day, including all values and ranges in between.

In some embodiments, the methods described herein are completed in about 0.5 hr to about 24 hours. In some embodiments, the methods are completed in about 0.5 hr, about 1 hr, about 2 hr, about 3 hr, about 4 hr, about 5 hr, about 6 hr, about 7 hr, about 8 hr, about 9 hr, about 10 hr, about 11 hr, about 12 hr, about 13 hr, about 14 hr, about 15 hr, about 16 hr, about 17 hr, about 18 hr, about 19 hr, about 20 hr, about 21 hr, about 22 hr, about 23 hr, or about 24 hr. In some embodiments, the methods described herein are completed in about 0.5 hr to about 8 hr. In some embodiments, the methods of the disclosure are completed in about 2 hr to about 6 hr.

In some embodiments, the purification yield of the biologic is at least 70%, at least 80%, at least 90%, at least 95%, at least 96%, at least 97%, at least 98%, or at least 99%.

In some embodiments, the biologic is purified to at least 70%, at least 80%, at least 90%, at least 95%, at least 96%, at least 97%, at least 98%, or at least 99% purity.

In some embodiments, the purified biologic retains its biological activity and/or structure. In some embodiments, the purified biologic has enhanced biological activity.

In some embodiments, at least 400 $g/m^2$ (grams of biologic per $m^2$ of filter membrane) are purified per day. In some embodiments, at least 400 $g/m^2$, at least 500 $g/m^2$, at least 600 $g/m^2$, at least 700 $g/m^2$, at least 800 $g/m^2$, at least 900 $g/m^2$, or at least 1000 $g/m^2$ of biologic are purified per day. In some embodiments, the biologic is a protein. In some embodiments, the protein is an antibody. In some embodiments, the biologic is a virus, such as an AAV, adenovirus, or lentivirus.

In some embodiments, at least about 150 g/L (grams of biologic per liters of protein-based purification matrix) are purified per day. In some embodiments, at least about 150 g/L, at least about 200 g/L, at least about 250 g/L, at least about 300 g/L, at least about 350 g/L, at least about 400 g/L, at least about 450 g/L, at least about 500 g/L, at least about 550 g/L, at least about 600 g/L, at least about 650 g/L, at least about 700 g/L, at least about 750 g/L, at least about 800 g/L, at least about 850 g/L, at least about 900 g/L, at least about 950 g/L, or at least about 1000 g/L are purified per day. In some embodiments, the biologic is a protein. In some embodiments, the protein is an antibody. In some embodiments, the biologic is a viral particle, such as an AAV particle.

Methods for Stabilizing Biologics

The instant inventors have discovered that the purification matrices described herein may unexpectedly help stabilize biologics during production, purification, and/or storage thereof. As used herein with relation to a biologic, the terms "stabilize" or "stabilizing" refers to the ability of a purification matrix to reduce degradation or aggregation of a biologic sample comprising a plurality of biologic molecules, to prevent biologic molecules from binding other proteins, or to enhance synthesis of a biologic by a producer cell.

Thus, in some embodiments, a biologic is contacted with a purification matrix during production, purification, or storage thereof. In some embodiments, a method of increasing yield of a biologic during production thereof comprises culturing biologic-producing cells in the presence of a purification matrix. In some embodiments, a method of stabilizing biologic during production thereof comprises culturing biologic-producing cells in the presence of a purification matrix. In some embodiments, a method of stabilizing biologics during purification thereof comprises contacting the biologic with a purification matrix during purification thereof. In some embodiments, a method of stabilizing a biologic during storage thereof comprises storing the biologic in the presence of a purification matrix. In some embodiments, a method of increasing the shelf-life of a biologic comprises storing the biologic in the presence of a purification matrix.

For example, a purification matrix may be contacted with a biologic during production of the biologic in culture. Biologics such as viral particles and proteins (e.g., monoclonal antibodies), for example, may be produced in production cell lines, such as HEK293 cells. In some embodiments, the production cell lines are transfected with one or more plasmids containing various genes required to produce a biologic. Adding the purification matrix to the biologic-producing cells in culture (e.g., by adding it to the tissue culture media) may increase the yield and/or quality of the biologic obtained during this process. In some embodiments, the purification matrix may be added to the culture at a concentration of about 1 μM to about 1 mM, for example, about 1 μM, about 2 μM, about 3 μM, about 4 μM, about 5 μM, about 6 μM, about 7 μM, about 8 μM, about 9 μM, about 10 μM, about 20 μM, about 30 μM, about 40 μM, about 50 μM, about 60 μM, about 70 μM, about 80 μM, about 90 μM, about 100 μM, about 150 μM, about 200 μM, about 250 μM, about 300 μM, about 350 μM, about 400 μM, about 450 μM, about 500 μM, about 550 μM, about 600 μM, about 650 μM, about 700 μM, about 750 μM, about 800 μM, about 850 μM, about 900 μM, about 950 μM, or about 1 mM, including all values and ranges in between. In some embodiments, the purification matrix is added to culture at a concentration of about 10 μM. In some embodiments, the purification matrix is added to culture at a concentration of about 100 μM. Without being bound by any theory, it is believed that the purification matrix can bind to and/or physically surround the biologic molecules as they are produced, thereby preventing them from binding other proteins. Thus, a protein or viral particle produced by a cultured cell and secreted into culture medium, in the presence of purification matrix, would not be able to re-bind to a receptor on a producer cell. In some embodiments, adding a purification matrix to biologic-producer cell lines in culture may increase the yield of the biologic. For example, adding a purification matrix to a viral-producing cell line in culture, such as a cell line producing lentiviral particles or adenoviral particles, may result in an increase in viral titer obtained by at least 2-fold, at least 3-fold, at least 4-fold, at least 5-fold, at least 6-fold, at least 7-fold, at least 8-fold, at least 9-fold, at least 10-fold, at least 50-fold, at least 100-fold, or more, compared to cells cultured without the purification matrix. Adding a purification matrix to a protein-producing cell line in culture may result in an increase in yield of protein obtained by at least 2-fold, at least 3-fold, at least 4-fold, at least 5-fold, at least 6-fold, at least 7-fold, at least 8-fold, at least 9-fold, at least 10-fold, at least 50-fold, at least 100-fold, or more, compared to cells cultured without the purification matrix.

As another example, after a purified biologic composition is prepared (using the methods described herein, or other methods known in the art), a purification matrix may be added to the sample before storage (e.g., freezing). Without being bound by any theory, it is believed that the purification matrix can bind to and/or physically surround biologic molecules, thus preventing them from aggregating with other biologic molecules, and also helping to protect them from degradation, particularly during multiple freeze-thaw cycles. Aggregation of biologic molecules may be observed visually by microscopy and/or by a technique selected from the group consisting of x-ray scattering, laser diffraction, analytical ultracentrifugation, dynamic light scattering, nanoparticle tracking analysis, resonant mass measurement, size exclusion chromatography, gel permeation chromatography, light obscuration, and combinations thereof. In some embodiments, the biologic may be frozen and stored in the presence of a purification matrix at temperatures between about −80° C. and about 40° C., for example, about −80° C., about −75° C., about −70° C., about −65° C., about −60° C., about −55° C., about −50° C., about −45° C., about −40° C., about −35° C., about −30° C., about −25° C., about −20° C., about −15° C., about −10° C., about −5° C., about 0° C., about 4° C., about 5° C., about 10° C., about 15° C., about 20° C., about 25° C., about 30° C., about 35° C., or about 40° C.

In some embodiments, when a biologic is stored in the presence of a purification matrix, the shelf life of the biologic is at least about 10% longer as compared to a sample stored in the absence of purification matrix. For example, in some embodiments, the shelf life is at least about 10%, at least about 20%, at least about 30%, at least about 40%, at least about 50%, at least about 60%, at least about 70%, at least about 80%, at least about 90%, at least about 100%, at least about 150%, at least about 200%, at least about 250%, at least about 300%, at least about 350%, at least about 400%, at least about 450%, or at least about 500% longer than the shelf life of a biologic stored in the absence of a purification matrix at about the same temperature.

In some embodiments, a biologic is stored at about −80° C. in the presence of a purification matrix. In some embodiments, a biologic is stored at about −20° C. in the presence of a purification matrix. In some embodiments, a biologic is stored at about 4° C. in the presence of a purification matrix.

In some embodiments, a biologic is stored at about 37° C. in the presence of a purification matrix. In some embodiments, when a biologic is stored in the presence of a purification matrix at about −80° C., about −20° C., about 4° C., or about 37° C., the shelf life of the biologic is at least about 10% longer than if it was stored in the absence of the purification matrix. For example, the shelf life of the biologic may be at least about 10%, at least about 20%, at least about 30%, at least about 40%, at least about 50%, at least about 60%, at least about 70%, at least about 80%, at least about 90%, at least about 100%, at least about 150%, at least about 200%, at least about 250%, at least about 300%, at least about 350%, at least about 400%, at least about 450%, or at least about 500% longer than the shelf life of the biologic stored in the absence of a purification matrix at the same temperature. As used herein, increased shelf life may refer to an increase in the amount of time a biologic is stored and still retains its function. For example, a viral particle that retains its function shares substantially the same level of infectivity.

Protein-Based Purification Matrices

Capture Domains

The protein-based purification matrices described herein may comprise a capture domain. In some embodiments, the capture domain binds a biologic. Non-limiting examples of biologics include a cell, a lipid, a lipopolysaccharide, a protein, a nucleic acid, a carbohydrate, or a virus.

In some embodiments, the capture domain binds a cell. In some embodiments, the cell is selected from the group consisting of a bacterial cell, yeast cell, or an animal cell such as a mammalian cell. In some embodiments, the cell is a chicken cell, a mouse cell, a guinea pig cell, a rat cell, a rabbit cell, a goat cell, a horse cell, a sheep cell, a dog cell, a cat cell, or a cow cell. In some embodiments, the cell is a human cell.

In some embodiments, the cell is a stem cell, a bone cell, a blood cell, a muscle cell, a fat cell, a skin cell, a nerve cell, an endothelial cell, a sex cell, a pancreatic cell, or a cancer cell.

In some embodiments, the cell is an immune cell. In some embodiments, the immune cell is a T cell, a B cell, a NK cell, a peripheral blood mononuclear cell, monocyte, macrophage, or a neutrophil. In some embodiments, the cell is a T cell expressing a chimeric antigen receptor (CAR).

In some embodiments, the capture domain binds a protein. In some embodiments, the protein is fibrous, globular, or a membrane protein. In some embodiments, the protein is an antibody.

In some embodiments, the capture domain binds an antibody or antigen-binding portion of a monoclonal antibody. In some embodiments, the capture domain binds to a fragment crystalline (Fc) region. In some embodiments, the Fc region is part of an antibody or antigen-binding portion of a monoclonal antibody. In some embodiments, the capture is Protein A or Protein G, which are known to bind to a Fc region.

In some embodiments, the capture domain comprises protein A, or a derivative or fragment thereof. Protein A (see, e.g., Uniprot Accession No. Q70AB8), binds to the Fc region of most immunoglobulins. The amino acid sequence of Protein A is: (M) AAQHDEAQQNAFYQVLNMPNLNADQRNGFIQSLKDDPSQSANVLGEAKKLNESQA PKADNNFNKEQQNAFYEILNMPNLNEEQRNGFIQSLKDDPSQSANLLSEAKKLNESQAP KADNKFNKEQQNAFYEILHLPNLNEEQRNGFIQSLKDDPSQSANLLAEAKKLNDAQAPK ADNKFNKEQQNAFYEILHLPNLTEEQRNG-

FIQSLKDDPSVSKEILAEAKKLNDAQAPKEE
DNNKPGKEDGNKPGKEDGN (SEQ ID NO: 126).

In some embodiments, the capture domain comprises Protein A having an amino acid sequence of SEQ ID NO: 126 with a mutation of A117G. In some embodiments, the capture domain comprises the B domain of Protein A or a fragment or derivative thereof, having the amino acid sequence of SEQ ID NO: 127. In some embodiments, the capture domain comprises the B domain of Protein A or a fragment or derivative thereof, having the amino acid sequence of SEQ ID NO: 127 with an amino acid mutation of A2G. In some embodiments, the capture domain comprises the C domain of Protein A or a fragment or derivative thereof, having the amino acid sequence of SEQ ID NO: 128. In some embodiments, the capture domain comprises the Z domain of Protein A or a fragment or derivative thereof, having the amino acid sequence of SEQ ID NO: 179. In some embodiments, the capture domain comprises the amino acid sequence of SEQ ID NO: 171 or an amino acid sequence having at least 90%, at least 95%, at least 96%, at least 97%, at least 98%, or at least 99% identity to SEQ ID NO: 171.

In some embodiments, the capture domain comprising Protein A, or a fragment or derivative thereof, comprises the amino acid sequence of SEQ ID NOs: 126-128 and 171 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising Protein A, or fragment or derivative thereof, comprises a sequence with at least 90%, at least 95%, at least 97%, or at least 99% identity to any one of SEQ ID NOs: 126-128 and 171.

Unless otherwise indicated, sequence identity is determined using the National Center for Biotechnology Information (NCBI)'s Basic Local Alignment Search Tool (BLASTR), available at blast.ncbi.nlm.nih.gov/Blast.cgi. In some embodiments, the sequence identity is calculated over the entire length of the compared sequences. In some embodiments, the sequence identity is calculated over a 20-amino acid, 50-amino acid, 75-amino acid, 100-amino acid, 250-amino acid, 500-amino acid, 750-amino acid, or 1000-amino acid fragment of each compared sequence.

In some embodiments, the capture domain comprises protein G, or a derivative or fragment thereof. Protein G (see, e.g., Uniprot Accession No. P19909), binds to the Fc region of most immunoglobulins. The acid amino sequence of Protein G is: (M) EKEKKVKYFLRKSAF-GLASVSAAFLVGSTVFAVDSPIEDTPIIRNG-GELTNLLGNSET TLALRNEESATADLTAAA-VADTVAAAAENAGAAAWEAAAAADALAKAKA-q DALKEF NKYGVSDYYKNLINNAKTVEG-VKDLQAQVVESAKKARISEATDGLSDFLKSQT-PAEDT VKSIELAEAKVLANRELDKYGVSDYHKN-LINNAKTVEGVKDLQAQVVESAKKARISEA TDGLSDFLKSQTPAEDTVKSIELAEAKVLAN-RELDKYGVSDYYKNLINNAKTVEGVKAL IDEI-LAALPKTDTYKLILNGKTLKGETTTEAVDAA-TAEKVFKQYANDNGVDGEWTYDD ATKTFTVTEKPEVIDASELTPAVTTYKL VINGKTLKGETTTEAVDAATAEKVFKQYAND NGVDGEWTYDDATKTFTVTEKPEVIDASELTPAVT-TYKL VINGKTLKGETTTKAVDAET AEKAFKQY-ANDNGVDGVWTYDDATKTFTVTEMVTEVPGDAPT-EPEKPEASIPL VPLTP ATPIAKDDAKKDDTKKEDAKKPEAKKEDAK-KAETLPTTGEGSNPFFTAAALAVMAGA GALA-VASKRKED (SEQ ID NO: 131).

In some embodiments, the capture domain comprises the G domain of Protein G or a fragment or derivative thereof, having the amino acid sequence of SEQ ID NO: 132. In some embodiments, the capture domain comprises a fragment of Protein G, having the amino acid sequence of SEQ ID NO: 133.

In some embodiments, the capture domain comprising Protein G, or a fragment or derivative thereof, comprises the amino acid sequence of SEQ ID NOs: 131-133 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising Protein G, or fragment or derivative thereof, comprises a sequence with at least 90%, at least 95%, at least 97%, or at least 99% identity to any one of SEQ ID NOs: 131-133.

In some embodiments, the capture domain binds to a kappa light chain. In some embodiments, the kappa light chain is part of an antibody or antigen-binding portion of a monoclonal antibody thereof. In some embodiments, the capture domain comprises protein L. Protein L binds to antibodies or antibody binding fragments thereof through interactions with the kappa light chain. The amino acid sequence of Protein L is: (M) KINKKLLMAALAGAIV-VGGGANAYAAEEDNTDNNLSMDEISDAY-FDYHGDVSDSV DPVEEEIDEALAKALAEAKET-AKKHIDSLNHLSETAKKLAKNDIDSATTINAIND-IVARA DVMERKTAEKEEAEKLAAAKETAKKH-IDELKHLADKTKELAKRDIDSATTINAINDIVA RAD-VMERKTAEKEEAEKLAAAKETAKKHIDELKHLAD-KTKELAKRDIDSATTIDAINDI VARADVMERKLSEKETPEPEEEVTIKANLIFADGSTQ-NAEFKGTFAKAVSDAYAYADAL KKDNGEYTVDVAD-KGLTLNIKFAGKKEKPEEPKEEVTIKVNLIFADGKTQ-TAEFKGTFE EATAKAYAYADLLAKENGEYTADLEDGGNTINIKF-AGKETPETPEEPKEEVTIKVNLIFA DGKIQTAEFKGT-FEEATAKAYAYANLLAKENGEYTADLEDGGN-TINIKFAGKETPETPE EPKEEVTIKVNLIFADGKTQTAEFKGTFEEATAEAY-RYADLLAKVNGEYTADLEDGGYT INIKFAGKEQP-GENPGITIDEWLLKNAKEEAIKELKEAGITSD-LYFSLINKAKTVEGVEAL KNEILKAHAGEETPELKDGYATYEE-AEAAAKEALKNDDVNNAYEIVQGADGRYYYVL KIEVADEEEPGEDTPEVQEGYATYEE-AEAAAKEALKEDKVNNAYEVVQGADGRYYYV LKIEDKEDEQPGEEPGENPGITIDEWLLKNAKEDAI-KELKEAGISSDIYFDAINKAKTVEG VEALK-NEILKAHAEKPGENPGITIDEWLLKNAKEAAI-KELKEAGITAEYLFNLINKAKTV EGVESLKNEILKAHAEKPGENPGITIDEWLLKNAKE-DAIKELKEAGITSDIYFDAINKAKT IEGVEALK-NEILKAHKKDEEPGKKPGEDKKPED-KKPGEDKKPEDKKPGEDKKPEDKKP GKTDKDSPNKKKKAKLPKAGSEAEILTLAAAAL-STAAGAYVSLKKRK (SEQ ID NO: 129).

In some embodiments, the capture domain comprises a fragment of Protein L having an amino acid sequence of SEQ ID NO: 130.

In some embodiments, the capture domain comprising Protein L, or a fragment or derivative thereof, comprises the amino acid sequence of SEQ ID NOs: 129-130 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising Protein L, or fragment or derivative thereof, comprises a sequence with at least 90%, at least 95%, at least 97%, or at least 99% identity to any one of SEQ ID NOs: 129-130.

In some embodiments, the capture domain binds an albumin, or derivative or fusion thereof. In some embodiments, the albumin is human serum albumin (HSA), bovine serum albumin (BSA), or ovalbumin. In some embodiments, the capture domain that binds an albumin comprises albumin-binding polypeptide, or a fragment or derivative thereof. In some embodiments, the albumin-binding polypeptide comprises an amino acid sequence of SEQ ID NO: 125. In some embodiments, the capture domain comprising an albumin-binding polypeptide, or fragment or derivative thereof, comprises the amino acid sequence of SEQ ID NO: 125 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising an albumin binding polypeptide, or fragment or derivative thereof, comprises a sequence with at least 90%, at least 95%, at least 97%, or at least 99% identity to SEQ ID NO: 125. In some embodiments, the capture domain that binds to albumin has an amino acid sequence of SEQ ID NO: 170, or an amino acid sequence with at least 90%, at least 95%, at least 96%, at least 97%, at least 98%, or at least 99% identity to SEQ ID NO: 170.

In some embodiments, the capture domain binds a nucleic acid. In some embodiments, the nucleic acid is a DNA or an RNA. In some embodiments, the nucleic acid is a DNA/RNA hybrid.

In some embodiments, the capture domain is a protein that binds to a nucleic acid. In some embodiments, the protein that binds to a nucleic acid binds to an adenosine and uridine rich element (ARE) of mRNA, a mRNA cap, a poly(A) tail, RNA, or double stranded DNA.

In some embodiments, the capture domain comprises mRNA decay activator protein ZFP36L2 (Tis11d), or a fragment or derivative thereof. Tis11d G (see, e.g., Uniprot Accession No. P47974) binds to an ARE. The amino acid sequence of Tis11d is: (M) STTLLSAFYDVDFLCK-TEKSLANLNLNNMLDK-KAVGTPVAAAPSSGFAPGFLRRHS ASNLHALAH-PAPSPGSCSPKFPGAANGSSCGSAAAGGPTSY-GTLKEPSGGGGTALLNKE NKFRDRSFSENGDR-SQHLLHLQQQQKGGGGSQINSTRYKTELCRP-FEESGTCKYGEKCQ FAHGFHELRSLTRHPKYKTEL-CRTFHTIGFCPYGPRCHFIHNADERRPAPSGGASG-DLRA FGTRDALHLGF-PREPRPKLHHSLSFSGFPSGHHQPPGGLESPLLLD-SPTSRTPPPPSCSSAS SCSSSASSCSSAS-AASTPSGAPTCCASAAAAAAAALLYGTGGAEDLLAP-GAPCAACSSAS CANNAFAFGPELSSLITPLAIQTHNFAAVAAAAYYR-SQQQQQQQGLAPPAQPPAPPSATL PAGAAAPPSPPFSFQLPRRLSDSPVFDAPPSPPDSLS-DRDSYLSGSLSSGSLSGSESPSLDPG RRLPIFSRL-SISDD (SEQ ID NO: 134). The methionine enclosed by parenthesis in the aforementioned sequence (M) or in any other sequences described herein is an initiator methionine. The presence of an initiator methionine is optional.

In some embodiments, the capture domain comprises a Tis11d fragment having an amino acid sequence of SEQ ID NO: 135. In some embodiments, the capture domain comprises the RNA binding domain of Tis11d having an amino acid sequence of SEQ ID NO: 136.

In some embodiments, the capture domain comprises Tis11d having an amino acid sequence of SEQ ID NO: 134 with at least one mutation selected from E195D, E195H, E195G, E195A, E195R, and E195K. In some embodiments, the capture domain comprises a Tis11d fragment having an amino acid sequence of SEQ ID NO: 135 with a mutation selected from at least one of E46D, E46H, E46G, E46A, E46R, and E46K. In some embodiments, the capture domain comprises the RNA binding domain of Tis11d having an amino acid sequence of SEQ ID NO: 136 with at least one mutation selected from E27D, E27H, E27G, E27A, E27R, and E27K.

In some embodiments, a capture domain comprising Tis11d, or a fragment or derivative thereof, comprises the amino acid sequence of SEQ ID NOs: 134-136 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising Tis11d, or a fragment or derivative thereof, comprises a sequence with at least 90%, at least 95%, at least 97%, or at least 99% identity to any one of SEQ ID NOs: 134-136.

In some embodiments, the capture domain comprises eukaryotic translation initiation factor 4E (eIF4E), or a fragment or derivative thereof. eIF4E (see, e.g., Uniprot Accession No. P06730) binds to the mRNA cap. The amino acid sequence of eIF4E is: (M) ATVEPETTPTPNPPT-TEEEKTESNQEVANPE-HYIKHPLQNRWALWFFKNDKSKTWQ ANLRL-ISKFDTVEDFWALYNHIQLSSNLMPGCDYSL-FKDGIEPMWEDEKNKRGGRWLIT LNKQQRRSDL-DRFWLETLLCLIGESFDDYSDDVCGAVVNVRAKGD-KIAIWTTECENRE AVTHIGR VYKERLGLPPKIVIGYQ-SHADTATKSGSTTKNRFVV (SEQ ID NO: 137).

In some embodiments, the capture domain comprises an eIF4E fragment having an amino acid sequence of SEQ ID NO: 138.

In some embodiments, a capture domain comprising eIF4E, or a fragment or derivative thereof, comprises the amino acid sequence of SEQ ID NOs: 137-138 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising eIF4E, or fragment or derivative thereof, comprises a sequence with at least 90%, at least 95%, at least 97%, or at least 99% identity to any one of SEQ ID NOs: 137-138.

In some embodiments, the capture domain comprises poly(A)-binding protein (PABP), or a fragment or derivative thereof. PABP (see, e.g., Uniprot Accession No. P11940) binds to the poly(A) tail of mRNA. The amino acid sequence of PABP is: (M) NPSAPSYPMASLYVGDLHPDVTEAM-LYEKFSPAGPILSIRVCRDMITRRSLGYAYVN FQQPA-DAERALDTMNFDVIKGKPVRIM-WSQRDPSLRKSGVGNIFIKNLDKSIDNKALYD TFSAFGNILSCKVVCDENG-
SKGYGFVHFETQEAAERAIEKMNGMLLN-
DRKVFVGRFKS RKEREAELGARAKEFTN-
VYIKNFGEDMDDERLKDLFGKFGPALSVKVM-
TDESGKSKGF GFVSFER-
HEDAQKAVDEMNGKELNGKQIYVGRAQKKVER-
QTELKRKFEQMKQDRITR YQGVNLYVKNLDDGID-
DERLRKEFSPFGTITSAKVMMEGGRSKGFGFVC-
FSSPEEATKA VTEMNGRIVATKPLYVALAQRKEER-
QAHLTNQYMQRMASVRAVPNPVINPYQPAPPSG
YFMAAIPQTQNRAAYYPPSQIAQLRPSPRWTAQG-
ARPHPFQNMPGAIRPAAPRPPFSTM RPASSQVPRVM-
STQRVANTSTQTMGPRPAAAAAAAT-
PAVRTVPQYKYAAGVRNPQQH
LNAQPQVTMQQPAVHVQGQEPLTASMLA-
SAPPQEQKQMLGERLFPLIQAMHPTLAGKI TGML-
LEIDNSELLHMLESPESLRSKVDEAVA-
VLQAHQAKEAAQKAVNSATGVPTV (SEQ ID NO: 139).

In some embodiments, the capture domain comprises a PABP fragment having an amino acid sequence of SEQ ID NO: 140. In some embodiments, the capture domain comprises the RNA recognition motif (RRM) 1 domain of PABP having an amino acid sequence of SEQ ID NO: 141. In some embodiments, the capture domain comprises the RRM2 domain of PABP having an amino acid sequence of SEQ ID NO: 142. In some embodiments, the capture domain comprises the RRM3 domain of PABP having an amino acid sequence of SEQ ID NO: 143. In some embodiments, the capture domain comprises the RRM4 domain of PABP having an amino acid sequence of SEQ ID NO: 144.

In some embodiments, a capture domain comprising PABP, or a fragment or derivative thereof, comprises the amino acid sequence of any one of SEQ ID NOs: 139-144 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising PABP, or fragment or derivative thereof, comprises a sequence with at least 90%, at least 95%, at least 97%, or at least 99% identity to any one of SEQ ID NOs: 139-144.

In some embodiments, the capture domain comprises Z-DNA binding protein 1 (ZBP1), or a fragment or derivative thereof. ZBP1 (see, e.g., Uniprot Accession No. Q9H171) binds to double stranded DNA. The amino acid sequence of ZBPI is: MAQAPADPGREGHLEQRILQVL-
TEAGSPVKLAQLVKECQAPKRELNQVLYRMKKELK
VSLTSPATWCLGGTDPEGEGPAELALSSPAER-
PQQHAATIPETPGPQFSQQREEDIYRFLK
DNGPQRALVIAQALGMRTAKDVNRDLYRMKSRHLL-
DMDEQSKAWTIYRPEDSGRRAK SASIIYQHNPIN-
MICQNGPNSWISIANSEAIQI-
GHGNIITRQTVSREDGSAGPRHLPSMAPG
DSSTWGTLVDPWGPQDIHMEQSILRRVQLGHS-
NEMRLHGVPSEGPAHIPPGSPPVSATA AGPEAS-
FEARIPSPGTHPEGEAAQRIHMKSCFLE-
DATIGNSNKMSISPGVAGPGGVAGSG
EGEPGEDAGRRPADTQSRSHFPRDIGQPITPSHSK-
LTPKLETMTLGNRSHKAAEGSHYVD
EASHEGSWWGGGI (SEQ ID NO: 145).

In some embodiments, the capture domain comprises Z-binding domain 1 of ZBP1 having an amino acid sequence of SEQ ID NO: 146. In some embodiments, the capture domain comprises Z-binding domain 2 of ZBPI having an amino acid sequence of SEQ ID NO: 147.

In some embodiments, a capture domain comprising ZBP1, or a fragment or derivative thereof, comprises the amino acid sequence of any one of SEQ ID NOs: 145-147 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising ZBP1, or fragment or derivative thereof, comprises a sequence with at least 90%, at least 95%, at least 97%, or at least 99% identity to any one of SEQ ID NOs: 145-147.

In some embodiments, the capture domain comprises PUM-HD domain-containing protein (PUM-HD), or a fragment or derivative thereof. PUM-HD (see, e.g., Uniprot Accession No. B2BXX4) binds to mRNA. The amino acid sequence of PUM-HD is: (M) HRGNEDLSFGDDYEKEI-
GLLLGEQQRRQEEADEIEKELN-
LYRSGSAPPTVDGSVNAA GGLFNGG-
GRGPFMEFGGGNKGNGFGGDDDELRKDPAYLSY-
YYANMKLNPRLPPPLMS REDLR-
VAQRLKGSSNVLGGVGDRRNVNESRSLF-
SMPPGFDQMNEFEAEKTNASSSEWD
ANGLIGLPGLGLGGKQKS-
FADIFQPDMGHPVSQQPSRPASRNAFDENVD-
STNNQSPSAS QGIGAPP-
PYSYAAVLGSSLSRNGTPDPQAVARVPSPCLTPIGS-
GRVSSNDKRNTSNQSPF NGVTSGL-
NESSDLVNALSGMNLSGSGGLDDRGQAEQD-
VEKVRNYMFGFQGGHNEVSQ
HVFPNKSDQAQKATGSLRNLHMRGSQGSAYN-
GGGLANPYQHLDSPNYCLNNYALNPA
VASVMANQLGNSNFSPMYDNYSAASAL-
GFSGMDSRLHGGGFESRNLGRSNRMMGGG GLQSH-
MADPMYHQYGRYSENVDALDLLND-
PAMDRSFMGNSYMNMLELQRAYLGAQ
KSQYGVPYKSGSPNSHSYYGSPTFGSNM-
SYPGSPLAHHAMQNSLMSPCSPMRRGEVNM RYP-
SATRNYSGGVMGSWHMDASLDE-
GFGSSLLEEFKSNKTRGFELSEIAGHVVEFSADQ
YGSRFIQQKLETATTDEKNMVYEEIMPHALA-
LMTDVFGNYVIQKFFEHGLPPQRRELGD
KLFENVLPLSLQMYGCRVIQKAIEVVDLDQKIK-
MVKELDGHVMRCVRDQNGNHVVQK CIECVPEE-
NIEFIISTFFGHVVSLSTHPYGCRVIQRVLEHCH-
DPDTQSKVMEEILSTVSMLA QDQYG-
NYVVQHVLEHGKPDERTVIIKELAGKIVQMSQQ-
KFASNVVEKCLTFGGPEEREL LVNEMLGTTDENE-
PLQAMMKDQFANYVVQKVLETCDDQQRELIL-
TRIKVHLNALKKY TYGKHV-
VARIEKLVAAGGMHMFLLLFPLGLKEENGFAVPNPA-
SDVVRPQVLYSLTRVDG SAIAF (SEQ ID NO: 148).

In some embodiments, a capture domain comprising PUM-HD, or a fragment or derivative thereof, comprises the amino acid sequence of SEQ ID NO: 148 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising PUM-HD, or fragment or derivative thereof, comprises a sequence with at least 90%, at least 95%, at least 97%, or at least 99% identity to SEQ ID NO: 148.

In some embodiments, the capture domain binds a virus. In some embodiments, the virus is an adenovirus, an adeno-associated virus (AAV), a lentivirus, a retrovirus, a poxvirus or a herpesvirus. In some embodiments, the virus is a wildtype or mutant AAV selected from AAV1, AAV2, AAV3 (including types 3A and 3B), AAV4, AAV5, AAV6, AAV7, AAV8, AAV9, AAV10, AAV11, AAV12, AAV13, AAVrh32.33, AAVrh8, AAVrh10, AAVrh74, AAVhu.68, avian AAV, bovine AAV, canine AAV, equine AAV, ovine AAV, snake AAV, bearded dragon AAV, AAV218, AAV2g9, AAV-LK03, AAV7m8, AAV Anc80, AAV PHP.B, and any other AAV now known or later discovered. In some embodiments, the capture domain that binds to an AAV particle has an amino acid sequence of SEQ ID NO: 166, or an amino acid sequence with at least 90%, at least 95%, at least 96%, at least 97%, at least 98%, or at least 99% identity to SEQ ID NO: 166.

In some embodiments, the capture domain binds an adenovirus particle. Adenoviruses are medium-sized (90-100 nm) nonenveloped viruses from the family Adenoviridae with an icosahedral nucleocapsid containing a double stranded DNA genome. There are four genera of the family Adenoviridae (e.g., Aviadenovirus, Mastadenovirus, Atadenovirus, Ichtadenovirus, Siadenovirus). In some embodiments, the capture domain binds to an adenovirus from Aviadenovirus, Mastadenovirus, Atadenovirus, Ichtadenovirus, or Siadenovirus. In some embodiments, the capture domain binds to an adenovirus from Mastadenovirus. Human adenoviruses are grouped into seven different adenovirus serotypes: A, B, C, D, E, F, G, and H. In some embodiments, the capture domain binds to a human adenovirus particle of serotypes A, B, C, D, E, F, G, or H.

The adenovirus capsid comprises three major types of proteins: hexon, penton base, and fiber. The coxsackievirus and adenovirus receptor (see, e.g., Uniprot Accession No. P78310), which is expressed on heart, brain epithelial, and endothelial cells, binds to the fiber protein of the adenovirus capsid. The amino acid sequence of the coxsackievirus and adenovirus receptor from *Homo sapiens* is: (M) ALLLCFVLLCGVVDFARSLSITTPEEMIEKAKGETAY-LPCKFTLSPEDQGPLDIEWLIS PADNQKVDQVII-LYSGDKIYDDYYPDLKGRVHFTSNDLKSGDAS-INVTNLQLSDIGTYQ CKVKKAPGVANKKIHLVVLVKPSGARCYVDGSEE-IGSDFKIKCEPKEGSLPLQYEWQKL SDSQKMPTSW-LAEMTSSVISVKNASSEYSGTY-SCTVRNRVGSDQCLLRLNVVPPSNKAG LIAGAIIGTLLALALIGLIIFCCRKKRREEKYEKEVHH-DIREDVPPPKSRTSTARSYIGSNHS SLGSMSPSNM-EGYSKTQYNQVPSEDFERTPQSPTLPPAK-VAAPNLSRMGAIPVMIPAQSK DGSIV (SEQ ID NO: 62).

In some embodiments, a capture domain of a purification matrix provided herein comprises the coxsackievirus and adenovirus receptor, or a fragment or derivative thereof.

In some embodiments, the capture domain comprising a coxsackievirus and adenovirus receptor, or fragment thereof, comprises an amino acid sequence selected from any one of SEQ ID NOs: 62-72. In some embodiments, the capture domain comprising a coxsackievirus and adenovirus receptor, or fragment thereof, comprises the amino acid sequence of any one of SEQ ID NOs: 62-72 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising a coxsackievirus and adenovirus receptor, or fragment thereof, comprises a sequence with at least 90%, at least 95%, at least 97%, or at least 99% identity to any one of SEQ ID NOs: 62-72.

In some embodiments, the capture domain comprises the extracellular domain of the coxsackievirus and adenovirus receptor, or a fragment thereof. In some embodiments, the capture domain comprising the extracellular domain of the coxsackievirus and adenovirus receptor has an amino acid sequence of SEQ ID NO: 63 or 64. In some embodiments, the capture domain comprises domain 1 of the coxsackievirus and adenovirus receptor, or a fragment thereof. In some embodiments, the capture domain comprising domain 1 of the coxsackievirus and adenovirus receptor has an amino acid sequence of SEQ ID NO: 65. In some embodiments, the capture domain comprises domain 2 of the coxsackievirus and adenovirus receptor, or a fragment thereof. In some embodiments, the capture domain comprising domain 2 of the coxsackievirus and adenovirus receptor has an amino acid sequence of SEQ ID NO: 66. In some embodiments, the capture domain comprises isoform 3 of the coxsackievirus and adenovirus receptor, or a fragment thereof. In some embodiments, the capture domain comprising isoform 3 of the coxsackievirus and adenovirus receptor has an amino acid sequence of SEQ ID NO: 67. In some embodiments, the capture domain comprises isoform 4 of the coxsackievirus and adenovirus receptor, or a fragment thereof. In some embodiments, the capture domain comprising isoform 4 of the coxsackievirus and adenovirus receptor has an amino acid sequence of SEQ ID NO: 68. In some embodiments, the capture domain comprises isoform 5 of the coxsackievirus and adenovirus receptor, or a fragment thereof. In some embodiments, the capture domain comprising isoform 5 of the coxsackievirus and adenovirus receptor has an amino acid sequence of SEQ ID NO: 69. In some embodiments, the capture domain comprises isoform 7 of the coxsackievirus and adenovirus receptor, or a fragment thereof. In some embodiments, the capture domain comprising isoform 7 of the coxsackievirus and adenovirus receptor has an amino acid sequence of SEQ ID NO: 70.

In some embodiments, the capture domain comprises an amino acid sequence of M(RAIVFRVQWLRRYFVNG-SRSGGG)n, where n is an integer from 1 to 8 (SEQ ID NO: 71), for example, n is 1, 2, 3, 4, 5, 6, 7, or 8. In some embodiments, the capture domain comprises an amino acid sequence of (RAIVFRVQWLRRYFVNGSRSGGG) n, wherein n is an integer from 1 to 8 (SEQ ID NO: 72), for example, 1, 2, 3, 4, 5, 6, 7, or 8.

In some embodiments, the capture domain that binds to an adenovirus particle has an amino acid sequence of SEQ ID NO: 167, or an amino acid sequence with at least 90%, at least 95%, at least 96%, at least 97%, at least 98%, or at least 99% identity to SEQ ID NO: 167.

In some embodiments, a capture domain of a purification matrix provided herein comprises the cluster of differentiation 80 (CD80), or a fragment or derivative thereof. CD80 (see, e.g., Uniprot Accession No. P33681) is a type 1 membrane protein of the immunoglobulin superfamily. CD80 binds to at least the knob domain of the fiber protein of adenovirus species B. The amino CD80 is acid sequence of from *Homo sapiens* (M) GHTRRQGT-SPSKCPYLNFFQLLVLAGLSHFCSGVIHVTKEVKEV-ATLSCGHNVSVEE LAQTRIYWQKEKKMVLTMMSGDMNIWPEYKNRTI-FDITNNLSIVILALRPSDEGTYECV VLKYEK-DAFKREHLAEVTLSVKADFPTPSISDFEIPTSNIRRIIC- STSGGGFPEPHLSWLENG
EELNAINTTVSQDPETELYAVSSK-
LDFNMTTNHSFMCLIKYGHLRVNQTFNWNTTKQEH
FPDNLLPSWAITLISVNGIFVICCLTYCFAPRCR-
ERRRNERLRRESVRPV (SEQ ID NO: 98).

In some embodiments, the capture domain comprises the extracellular domain of CD80, or a fragment or derivative thereof, having an amino acid sequence of SEQ ID NO: 99 or SEQ ID NO: 100.

In some embodiments, the capture domain comprising CD80, or a fragment or derivative thereof, comprises an amino acid sequence selected from any one of SEQ ID NOs: 98-100. In some embodiments, the capture domain comprising CD80, or a fragment or derivative thereof, comprises the amino acid sequence of any one of SEQ ID NOs: 98-100 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising CD80, or fragment thereof, comprises a sequence with at least 90%, at least 95%, at least 97%, or at least 99% identity to any one of SEQ ID Nos: 98-100.

In some embodiments, a capture domain of a purification matrix provided herein comprises the cluster of differentiation 86 (CD86), or a fragment or derivative thereof. CD86 (see, e.g., Uniprot Accession No. P42081) is a type 1 membrane protein of the immunoglobulin superfamily. CD86 binds to at least the knob domain of the fiber protein of adenovirus species B. The amino acid sequence of CD86 from *Homo sapiens* is (M)DPQCTMGLSNILFVMA-FLLSGAAPLKIQAYFNETADLPCQFANSQNQSL-SELVVFWQ DQENLVLNEVYLGKEKFDSVHSKY-MGRTSFDSDSWTLRLHNLQIKDKGLYQCIIHHKKP TGMIRIHQMNSELSVLANFSQPEIVPISNITEN-VYINLTCSSIHGYPEPKKMSVLLRTKNST IEY-DGVMQKSQDNVTELYDVSISLSVSFPDVTSNMTIFCI-LETDKTRLLSSPFSIELEDPQP PPDHIPWITAVLPTVIICVMVFCLILWKWKKKKRPRN-SYKCGTNTMEREESEQTKKREKI HIPERSDEA-QRVFKSSKTSSCDKSDTCF (SEQ ID NO: 101).

In some embodiments, the capture domain comprises the extracellular domain of CD86. In some embodiments, the capture domain comprises the extracellular domain of CD86, having an amino acid sequence of SEQ ID NO: 102. In some embodiments, the capture domain comprises a fragment of the extracellular domain of CD86, having an amino acid sequence of SEQ ID NOs: 103 or 104.

In some embodiments, the capture domain comprising CD86, or a fragment or derivative thereof, comprises an amino acid sequence selected from any one of SEQ ID NOs: 101-104. In some embodiments, the capture domain comprising CD86, or a fragment or derivative thereof, comprises the amino acid sequence of any one of SEQ ID NOs: 101-104 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising CD86, or fragment thereof, comprises a sequence with at least 90%, at least 95%, at least 97%, or at least 99% identity to any one of SEQ ID Nos: 101-104.

In some embodiments, the capture domain binds a lentovirus particle. Lentivirus is a genus of retroviruses that causes chronic and deadly diseases characterized by long incubation periods. Examples of lentiviruses include human immunodeficiency virus (HIV) and vesicular stomatitis virus (VSV). There are five serogroups of lentivirus: bovine, equine, feline, ovinecaprine, and primate. In some embodiments, the capture domain binds a lentovirus particle of the bovine, equine, feline, ovinecaprine, or primate serogroups. In some embodiments, lentiviruses infect host cells via binding to the low-density lipoprotein receptor (LDLR) or cluster of differentiation 4 (CD4).

In some embodiments, the capture domain that binds to an lentivirus particle has an amino acid sequence of SEQ ID NO: 168, or an amino acid sequence with at least 90%, at least 95%, at least 96%, at least 97%, at least 98%, or at least 99% identity to SEQ ID NO: 168. In some embodiments, the capture domain that binds to an lentivirus particle has an amino acid sequence of SEQ ID NO: 169, or an amino acid sequence with at least 90%, at least 95%, at least 96%, at least 97%, at least 98%, or at least 99% identity to SEQ ID NO: 169.

In some embodiments, a capture domain of a purification matrix provided herein comprises the LDLR, or a fragment or derivative thereof. LDLR (see, e.g., Uniprot Accession No. PO1130) is a cell-surface receptor that mediates the endocytosis of cholesterol rich low-density lipoprotein. The amino acid sequence of LDLR from *Homo sapiens* is (M)GPWGWKLRWTVALL-LAAAGTAVGDRCERNEFQCQDGKCISYKWVCDG-SAECQDG SDESQETCLSVTCKSGDFSCGGRVNR-CIPQFWRCDGQVDCDNGSDEQGCPPKTCSQDEF RCHDGKCISRQFVCDSDRDCLDGS-DEASCPVLTCGPASFQCNSSTCIPQLWACDNDPDC EDGSDEWPQRCRGLY-VFQGDSSPCSAFEFHCLSGECIHSS-WRCDGGPDCKDKSDEENCA VATCRPDEFQCSDGN-CIHGSRQCDREYDCKDMSDEVGCVNVTLCEGP-NKFKCHSGECI TLDKVCNMARDCRDWSDEPIKE-CGTNECLDNNGGCSHVCNDLKIGYECLCPDGFQLVA QRRCEDIDECQDPDTCSQLCVNLEGGYKCQ-CEEGFQLDPHTKACKAVGSIAYLFFTNRH EVRKMTLDRSEYTSLIPNLRNVVALDTEVASN-RIYWSDLSQRMICSTQLDRAHGVSSYD TVIS-RDIQAPDGLAVDWIHSNIYWTDSVLGTVS-VADTKGVKRKTLFRENGSKPRAIVVD PVHGFMYWTDWGTPAKIKKGGLNGVDIYSLVTE-NIQWPNGITLDLLSGRLYWVDSKLH SISSIDVNGG-NRKTILEDEKRLAHPFSLAVFEDKVFWTDI-INEAIFSANRLTGSDVNLLAE NLLSPEDMVLFHNLTQPRGVNWCERTTL-SNGGCQYLCLPAPQINPHSPKFTCACPDGML LARDMRSCLTEAEAAVATQET-STVRLKVSSTAVRTQHTTTRPVPDTSRLPGATPGLTTV EIVTMSHQALGDVAGRGNEKKPSSVRALSIVLPIVLL-VFLCLGVFLLWKNWRLKNINSIN FDNPVYQKT-TEDEVHICHNQDGYSYPSRQMVSLEDDVA (SEQ ID NO: 73).

In some embodiments, the capture domain comprises the extracellular domain of LDLR having an amino acid sequence of SEQ ID NO: 74. In some embodiments, the capture domain comprises a fragment of the extracellular domain of LDLR having an amino acid sequence of SEQ ID NO: 77. In some embodiments, the capture domain comprises the CR2 domain of LDLR having an amino acid sequence of SEQ ID NO: 75. In some embodiments, the capture domain comprises the CR3 domain of LDLR having an amino acid sequence of SEQ ID NO: 76.

In some embodiments, the capture domain comprising LDLR, or a fragment or derivative thereof, comprises an amino acid sequence selected from any one of SEQ ID NOs: 73-76. In some embodiments, the capture domain comprising LDLR, or a fragment or derivative thereof, comprises the amino acid sequence of any one of SEQ ID NOs: 73-76 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising LDLR, or fragment thereof, comprises a sequence with at least 90%, at least 95%, at least 97%, or at least 99% identity to any one of SEQ ID Nos: 73-76.

In some embodiments, a capture domain of a purification matrix provided herein comprises CD4, or a fragment or derivative thereof. In some embodiments, a capture domain comprising CD4 binds to a lentivirus particle or a retrovirus particle. In some embodiments, CD4 binds to glycoprotein 120 (gp120) of human immunodeficiency virus.

CD4 (see, e.g., Uniprot Accession No. P01730) is a glycoprotein found on the surface of immune cells such as T helper cells, monocytes, macrophages, and dendritic cells. The amino acid sequence of CD4 from *Homo sapiens* is (M)NRGVPFRHLLLVLQLALL-PAATQGKKVVLGKKGDTVELTCTASQKKSIQFHW-KNSN QIKILGNQGSFLTKGPSKLN-DRADSRRSLWDQGNFPLIIKNLKIEDSDTYICEV-EDQKEEV QLLVFGLTANSDTH-LLQGQSLTLTLESPPGSSPSVQCRSPRGK-NIQGGKTLSVSQLELQD SGTWTCTVLQNQKKVEFKIDIVVLAFQKAS-SIVYKKEGEQVEFSFPLAFTVEKLTGSGEL WWQAER-ASSSKSWITFDLKNKEV-SVKRVTQDPKLQMGKKLPLHLTLPQALPQYAGSG NLTLALEAKTGKLHQEVNLVVMRATQLQKNLTCE-VWGPTSPKLMLSLKLENKEAKVS KREKAVWVLNPEAGMWQCLLSDSGQVLLE-SNIKVLPTWSTPVQPMALIVLGGVAGLLL FIGL-GIFFCVR-CRHRRRQAERMSQIKRLLSEKKTCQCPHRFQKTCSPI (SEQ ID NO: 78).

In some embodiments, the capture domain comprises CD4 having an amino acid sequence of SEQ ID NO: 78. In some embodiments, the capture domain comprises CD4 having an amino acid sequence of SEQ ID NO: 78 having at least one, at least two, at least three, or at least four mutations of amino acids 112, 113, 116, and 117 to glycine, alanine, lysine, arginine, or histidine.

In some embodiments, the capture domain comprises the extracellular domain of CD4. In some embodiments, the capture domain comprises the extracellular domain of CD4 having an amino acid sequence of SEQ ID NO: 79.

In some embodiments, the capture domain comprises a fragment of the extracellular domain of CD4 having an amino acid sequence of SEQ ID NO: 80. In some embodiments, the capture domain comprises domain 1 of CD4 having an amino acid sequence of SEQ ID NO: 81. In some embodiments, the capture domain comprises the extracellular domain of CD4 or a fragment or derivative thereof (SEQ ID NOs: 79-81) having at least one, at least two, at least three, or at least four mutations at amino acids 88, 89, 92, and 93 to glycine, alanine, lysine, arginine, or histidine.

In some embodiments, the capture domain comprising CD4, or a fragment or derivative thereof, comprises an amino acid sequence selected from any one of SEQ ID NOs:

78-81. In some embodiments, the capture domain comprising CD4, or a fragment or derivative thereof, comprises the amino acid sequence of any one of SEQ ID NOs: 78-81 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising CD4, or fragment thereof, comprises a sequence with at least 90%, at least 95%, at least 97%, or at least 99% identity to any one of SEQ ID Nos: 78-81.

In some embodiments, a capture domain of a purification matrix provided herein comprises cluster of differentiation 46 (CD46), or a fragment or derivative thereof. In some embodiments, a capture domain comprising CD46 or a fragment or derivative thereof binds to a measles virus particle, a herpesvirus particle, an adenovirus particle, *Streptococcus pyogenes*, or pathogenic Nesseria. CD46 (see, e.g., Uniprot Accession No. P15529) is a type 1 membrane protein and is a regulatory part of the complement system. In some embodiments, a capture domain comprising CD46 or a fragment or derivative thereof binds to group B adenoviruses. In some embodiments, a capture domain comprising CD46 or a fragment or derivative thereof binds to human herpesvirus-6. The amino acid sequence of CD46 is: (M) EPPGRRECPFPSWRFPGLLLAAMVLLLYSFSDA-CEEPPTFEAMELIGKPKPYYEIGER VDYKCKKGYFYIPPLATHTICDRNHTWLPVSDDA-CYRETCPYIRDPLNGQAVPANGTYE FGYQMHFICN-EGYYLIGEEILYCELKGSVAIWSGKPPICEKVLCTPPP-KIKNGKHTFSEVE VFEYLDAVTYSCDPAPGPDPFSLIGESTIYCGDNS-VWSRAAPECKVVKCRFPVVENGKQI SGFGKKFYYKATVMFECDKGFYLDGSD-TIVCDSNSTWDPPVPKCLKVLPPSSTKPPALS HSVST-SSTTKSPASSASGPRPTYKPPVSNYPGYPKPEEGILD-SLDVWVIAVIVIAIVVGVA VICVVPYRYLQRRKKKGTYLTDETHREVKFTSL (SEQ ID NO: 82).

In some embodiments, a capture domain comprises the extracellular domain of CD46 or a fragment or derivative thereof. In some embodiments, a capture domain comprises the extracellular domain of CD46 or a fragment or derivative thereof, having an amino acid sequence of SEQ ID NO: 83 or SEQ ID NO: 84. In some embodiments, the capture domain comprises domain 1 of CD46 having an amino acid sequence of SEQ ID NO: 85. In some embodiments, the capture domain comprises domain 2 of CD46 having an amino acid sequence of SEQ ID NO: 86. In some embodiments, the capture domain comprises domain 3 of CD46 having an amino acid sequence of SEQ ID NO: 87. In some embodiments, the capture domain comprises domain 4 of CD46 having an amino acid sequence of SEQ ID NO: 88. In some embodiments, the capture domain comprises domain 5 of CD46 having an amino acid sequence of SEQ ID NO: 89.

In some embodiments, the capture domain comprising CD46, or a fragment or derivative thereof, comprises an amino acid sequence selected from any one of SEQ ID NOs: 82-89. In some embodiments, the capture domain comprising CD46, or a fragment or derivative thereof, comprises the amino acid sequence of any one of SEQ ID NOs: 82-89 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising CD46, or fragment thereof, comprises a sequence with at least 90%, at least 95%, at least 97%, or at least 99% identity to any one of SEQ ID Nos: 82-89.

In some embodiments, the capture domain binds a measles virus particle. Measles virus is a single-stranded, negative-sense, enveloped, non-segmented RNA virus of the genus Morbillivirus within the family Paramyxoviridae. The measles virus has two envelope glycoproteins on the viral surface: hemagglutinin (H) and membrane fusion protein (F). Receptors for the measles H protein include CD46, the signaling lymphocyte activation molecule (SLAMF1), and the cell adhesion molecule Nectin-4.

In some embodiments, a capture domain of a purification matrix provided herein comprises SLAMF1, or a fragment or derivative thereof. In some embodiments, a capture domain comprising SLAMF1 or a fragment or derivative thereof binds to a measles virus particle. SLAMF1 (see, e.g., Uniprot Accession No. Q13291) belongs to the signaling lymphocytic activation molecule family. The amino acid sequence of SLAMF1 is: (M)DPKGLLSLTFVLFLSLAF-GASYGTGGRMMNCPKILRQLGSKVLLPLTYER-INKSMNK SIHIVVTMAKSLENSVENKIVSLDPSEA-GPPRYLGDRYKFYLENLTLGIRESRKEDEGWY LMTLEKNVSVQRFCLQLRLYEQVST-PEIKVLNKTQENGTCTLILGCTVEKGDHVAYSWS EKAGTHPLNPANSSHLLSLTLGPQHADNIYICTVSN-PISNNSQTFSPWPGCRTDPSETKPW AVYAGLLGGVI-MILIMVVILQLRRRGKTNHYQTTVEKKSLTI-YAQVQKPGPLQKKLDSF PAQDPCTTIYVAATEPVPESVQETNSITVYASVTLPES (SEQ ID NO: 90).

In some embodiments, a capture domain comprises the extracellular domain of SLAMF1 or a fragment or derivative thereof. In some embodiments, a capture domain comprises the extracellular domain of SLAMF1 or a fragment or derivative thereof, having an amino acid sequence of SEQ ID NO: 91 or SEQ ID NO: 92.

In some embodiments, the capture domain comprising SLAMF1, or a fragment or derivative thereof, comprises an amino acid sequence selected from any one of SEQ ID NOs: 90-92. In some embodiments, the capture domain comprising SLAMF1, or a fragment or derivative thereof, comprises the amino acid sequence of any one of SEQ ID NOs: 90-92 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising SLAMF1, or fragment thereof, comprises a sequence with at least 90%, at least 95%, at least 97%, or at least 99% identity to any one of SEQ ID Nos: 90-92.

In some embodiments, a capture domain of a purification matrix provided herein comprises Nectin-4, or a fragment or derivative thereof. In some embodiments, a capture domain comprising Nectin-4 or a fragment or derivative thereof binds to a measles virus particle. Nectin-4 (see, e.g., Uniprot Accession No. Q96NY8) belongs to the family of cellular adhesion molecules involved in calcium-independent cellular adhesion. The amino acid sequence of Nectin-4 is: (M)PLSLGAEMWGPEAWLLLLLLLASFTGRCPAGE-LETSDVVTVVLGQDAKLPCFYRGD SGEQVGQVAWARVDAGEGAQELALLHSKYGLHVS-PAYEGRVEQPPPPRNPLDGSVLLR NAVQADEGEYE-CRVSTFPAGSFQARLRLRVLVPPLPSLNPGPA-LEEGQGLTLAASCTAE GSPAPSVTWDTEVKGTTSSRSFKHSRSAAVT-SEFHLVPSRSMNGQPLTCVVSHPGLLQD QRITH-ILHVSFLAEASVRGLEDQNLWHIGRE-GAMLKCLSEGQPPPSYNWTRLDGPLPSG VRVDGDTLGFPPLTTEHSGIYVCHVS-NEFSSRDSQVTVDVLDPQEDSGKQVDLVSASVV VVGVIAALLFCLL-VVVVVLMSRYHRRKAQQMTQKYEEELTLTREN-SIRRLHSHHTDPRS QPEESVGLRAEGHPDSLKDNSS-CSVMSEEPEGRSYSTLTTVREIETQTELLSPGSGR-AEEE EDQDEGIKQAMNHFVQENGTLRAKPTGNGIY-INGRGHLV (SEQ ID NO: 93).

In some embodiments, a capture domain comprises the extracellular domain of Nectin-4 or a fragment or derivative thereof. In some embodiments, a capture domain comprises the extracellular domain of Nectin-4 or a fragment or derivative thereof, having an amino acid sequence of SEQ ID NO: 94. In some embodiments, a capture domain comprises domain 1 of Nectin-4 or a fragment or derivative thereof, having an amino acid sequence of SEQ ID NO: 95. In some embodiments, a capture domain comprises domain 2 of Nectin-4 or a fragment or derivative thereof, having an amino acid sequence of SEQ ID NO: 96. In some embodiments, a capture domain comprises domain 3 of Nectin-4 or a fragment or derivative thereof, having an amino acid sequence of SEQ ID NO: 97.

In some embodiments, the capture domain comprising Nectin-4, or a fragment or derivative thereof, comprises an amino acid sequence selected from any one of SEQ ID NOs: 93-97. In some embodiments, the capture domain comprising Nectin-4, or a fragment or derivative thereof, comprises the amino acid sequence of any one of SEQ ID NOs: 93-97 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising Nectin-4, or fragment thereof, comprises a sequence with at least 90%, at least 95%, at least 97%, or at least 99% identity to any one of SEQ ID Nos: 93-97.

In some embodiments, the capture domain binds a baboon endogenous virus particle. Baboon endogenous virus (BaEV) is a type C endogenous oncovirus. BaEV contains a type D envelope (env) gene. BaEV virus particles bind to neutral amino acid transporter B (0) (SLC1A5) and/or neutral amino acid transporter A (SLC1A4).

In some embodiments, a capture domain of a purification matrix provided herein comprises SLC1A5, or a fragment or derivative thereof. SLC1A5 (see, e.g., Uniprot Accession No. Q15758) is a sodium-dependent amino acid transporter. The amino acid sequence of SLC1A5 is: (M)VADPPRD-SKGLAAAEPTANGGLA-LASIEDQGAAAGGYCGSRDQVRRCLRANLLVL LTVVAVVAGVALGLGVSGAGGALALGPERL-SAFVFPGELLLRLLRMIILPLVVCSLIGGAASLDPGAL-GRLGAWALLFFLVTTLLASALGVGLALALQP-GAASAAINASVGAAGSAEN APSKEVLDSFLDLARNIFPSNLVSAAFRSYSTTYEER-NITGTRVKVPVGQEVEGMNILGL VVFAIVFGVALRKLGPEGEL-LIRFFNSFNEATMVLVSWIMWYAPVGIMFLVAG-KIVEME DVGLLFARLGKYILCCLLGHAIHGLL-VLPLIYFLFTRKNPYRFLWGIVTPLATAFGTSSSS ATLPLMMKCVEENNGVAKHISRFILPIGATVNMD-GAALFQCVAAVFIAQLSQQSLDFVK IITILVTA-TASSVGAAGIPAGGVLTLAIILEAVNLPVDHIS- LILAVDWLVDRSCTVLNVEGD
ALGAGLLQNYVDRTESRSTEPELI-
QVKSELPLDPLPVPTEEGNPLLKHYRGPAGDATVAS
EKESVM (SEQ ID NO: 105).

In some embodiments, a capture domain comprises the extracellular domain of SLC1A5 or a fragment or derivative thereof. In some embodiments, a capture domain comprises the extracellular domain of SLC1A5 or a fragment or derivative thereof, having an amino acid sequence of any one of SEQ ID NOs: 106-110.

In some embodiments, the capture domain comprising SLC1A5, or a fragment or derivative thereof, comprises an amino acid sequence selected from any one of SEQ ID NOs: 105-110. In some embodiments, the capture domain comprising SLC1A5, or a fragment or derivative thereof, comprises the amino acid sequence of any one of SEQ ID NOs: 105-110 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising SLC1A5, or fragment thereof, comprises a sequence with at least 90%, at least 95%, at least 97%, or at least 99% identity to any one of SEQ ID NOs: 105-110.

In some embodiments, a capture domain of a purification matrix provided herein comprises SLC1A4, or a fragment or derivative thereof. SLC1A4 (see, e.g., Uniprot Accession No. P43007) is a transporter of alanine, serine, cysteine, and threonine. The amino acid sequence of SLC1A4 is: (M)EKSNETNGYLDSAQAGPAAGPGAPGTAA-
GRARRCAGFLRRQALVLLTVSGVLAGA GLGAALR-
GLSLSRTQVTYLAFPGEMLLRMLRMIIL-
PLVVCSLVSGAASLDASCLGRLGGI
AVAYFGLTTLSASALAVA-
LAFIIKPGSGAQTLQSSDLGLED-
SGPPPVPKETVDSFLDLAR NLFPSNLVVAAF-
RTYATDYKVVTQNSSSGNVTHEKIPIGTEIEGM-
NILGLVLFALVLGVA LKKLGSEGEDLIRFFNSL-
NEATMVLVSWIMWYVPVGIMFLVGSKIVEMK-
DIIVLVTSLGK YIFASILGHVIHG-
GIVLPLIYFVFTRKNPFRFLLGLLAPFATAFATCSSS-
ATLPSMMKCIEE NNGVDKRISRFILPIGATVNMD-
GAAIFQCVAAVFIAQLNNVELNAGQIFTILVTA-
TASSVG AAGVPAGGVL-
TIAIILEAIGLPTHDLPLILAVDWIVDRTTTVVNVE-
GDALGAGILHHLNQ KATKKGEQE-
LAEVKVEAIPNCKSEEETSPLVTHQNPAGPVASAPE-
LESKESVL (SEQ ID NO: 111).

In some embodiments, a capture domain comprises the extracellular domain of SLC1A4 or a fragment or derivative thereof. In some embodiments, a capture domain comprises the extracellular domain of SLC1A4 or a fragment or derivative thereof, having an amino acid sequence of SEQ ID NO: 112. In some embodiments, a capture domain comprises a fragment of SLC1A4 or a fragment or derivative thereof, having an amino acid sequence of SEQ ID NO: 113.

In some embodiments, the capture domain comprising SLC1A4, or a fragment or derivative thereof, comprises an amino acid sequence selected from any one of SEQ ID NOs: 111-113. In some embodiments, the capture domain comprising SLC1A4, or a fragment or derivative thereof, comprises the amino acid sequence of any one of SEQ ID NOs: 111-113 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising SLC1A4, or fragment thereof, comprises a sequence with at least 90%, at least 95%, at least 97%, or at least 99% identity to any one of SEQ ID NOs: 111-113.

In some embodiments, the capture domain binds a Nipah or Hendra virus particle. Nipah and Hendra viruses are both members of the Paramyxoviridae family and cause respiratory and nervous system disease. Nipah and Hendra viruses enter cells via the ephrin-B2 and ephrin-B3.

In some embodiments, a capture domain of a purification matrix provided herein comprises ephrin-B2, or a fragment or derivative thereof. In some embodiments, a capture domain comprising ephrin-B2 or a fragment or derivative thereof binds to a Nipah virus particle or a Hendra virus particle. Ephrin-B2 (see, e.g., Uniprot Accession No. P52799) binds promiscuously to ephrin receptors. Ephrin receptors are a family of receptor tyrosine kinases which are crucial for migration, repulsion, and adhesion during neuronal, vascular, and epithelial development. The amino acid sequence of ephrin-B2 is: (M)AVRRDSVWKYCWGVLMVLCR-
TAISKSIVLEPIYWNSSNSKFLPGQGLVLYPQIGDK
LDIICPKVDSKTVGQYEYYKVYMVDKDQADRCTIK-
KENTPLLNCAKPDQDIKFTIKFQE FSPNLW-
GLEFQKNKDYYIISTSNG-
SLEGLDNQEGGVCQTRAMKILMKVGQDASSAGSTR
NKDPTRRPELEAGTNGRSSTTSPFVKPNPGSSTDGN-
SAGHSGNNILGSEVALFAGIASGCI
IFIVIIITLVVLLLKYRRRHRKHSPQHTTTLSLST-
LATPKRSGNNNGSEPSDIIIPLRTADSVF CPHY-
EKVSGDYGHPVYIVQEMPPQSPANIYYKV (SEQ ID NO: 114).

In some embodiments, a capture domain comprises the extracellular domain of ephrin-B2 or a fragment or derivative thereof. In some embodiments, a capture domain comprises the extracellular domain of ephrin-B2 or a fragment or derivative thereof, having an amino acid sequence of SEQ ID NO: 115.

In some embodiments, the capture domain comprising ephrin-B2, or a fragment or derivative thereof, comprises an amino acid sequence selected from SEQ ID NO: 114 or SEQ ID NO: 115. In some embodiments, the capture domain comprising ephrin-B2, or a fragment or derivative thereof, comprises the amino acid sequence of SEQ ID NO: 114 or SEQ ID NO: 115 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising ephrin-B2, or fragment thereof, comprises a sequence with at least 90%, at least 95%, at least 97%, or at least 99% identity to SEQ ID NO: 114 or SEQ ID NO: 115.

In some embodiments, the capture domain binds a retrovirus particle. In some embodiments, the capture domain binds to Gibbon-ape leukemia virus (GaLV). GaLV is an oncogenic type C retrovirus isolated from the white-handed gibbon and wooly monkey. GaLV virus enters host cells via the sodium-dependent phosphate transporter 1 (SLC20A1) or sodium-dependent phosphate transporter 2 (SLC20A2).

In some embodiments, a capture domain of a purification matrix provided herein comprises SLC20A1, or a fragment or derivative thereof. In some embodiments, a capture domain comprising SLC20A lor a fragment or derivative thereof binds to a GaL V virus particle. SLC20A1 (see, e.g., Uniprot Accession No. Q8WUM9) is a sodium-phosphate symporter, which confers human cells susceptibility to GaLV. The amino acid sequence of SLC20A1 is: MATLIT-STTAATAASGPLVDYLWMLILGFIIAFVLAFSVGAND-VANSFGTAVGSGVVTL KQACILASIFETVGSVLL-GAKVSETIRKGLIDVEMYNSTQGLLMAGSVSAMF-GSAVWQL VASFLKLPISGTHCIVGATIGFSL-VAKGQEGVKWSELIKIVMSWFVSPLLSGIMSGILF-FLV RAFILHKADPVPNGLRALPVFYACTVGINLF-SIMYTGAPLLGFDKLPLWGTILISVGCAVF CALIVWFFVCPRMKRKIEREIKCSPSESPLMEK-KNSLKEDHEETKLSVGDIENKHPVSEV GPATVPLQAVVEERTVSFKLGDLEEAPERERLPSVDL-KEETSIDSTVNGAVQLPNGNLVQ FSQAVSNQIN-SSGHYQYHTVHKDSG-LYKELLHKLHLAKVGDCMGDSGDKPLRRNNSY TSYTMAICGMPLDSFRAKEGEQKGEEME-KLTWPNADSKKRIRMDSYTSYCNAVSDLHS ASEIDMSVKAEMGLGDRKGSNGSLEEWYDQDKPE-VSLLFQFLQILTACFGSFAHGGND VSNAIGPLVALYL-VYDTGDVSSKVATPIWLLLYGGVG-ICVGLWVVWGRRVIQTMGKDLT PITPSSGFSIELASALTVVI-ASNIGLPISTTHCKVGSVVSVGWLRSKKAVDWRLFR-NIFMA WFVTVPISGVISAAIMAIFRYVILRM (SEQ ID NO: 116).

In some embodiments, a capture domain comprises a fragment of SLC20A1, having an amino acid sequence of any one of SEQ ID NOs: 117 and 118. In some embodiments, a capture domain comprises SLC20A1 or a fragment or derivative thereof, having an amino acid sequence of SEQ ID NO: 116 with a mutation of Asp-550 to lysine, arginine, glycine, alanine, or histidine. In some embodiments, a capture domain comprises SLC20A1 or a fragment or derivative thereof, having an amino acid sequence of SEQ ID NO: 117 with a mutation of Asp-20 to lysine, arginine, glycine, alanine, or histidine.

In some embodiments, the capture domain comprising SLC20A1, or a fragment or derivative thereof, comprises an amino acid sequence selected from any one of SEQ ID NOs: 116-118. In some embodiments, the capture domain comprising SLC20A1, or a fragment or derivative thereof, comprises the amino acid sequence of any one of SEQ ID Nos: 116-118 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising SLC20A1, or fragment thereof, comprises a sequence with at least 90%, at least 95%, at least 97%, or at least 99% identity to any one of SEQ ID NOs: 116-118.

In some embodiments, a capture domain of a purification matrix provided herein comprises SLC20A2, or a fragment or derivative thereof. In some embodiments, a capture domain comprising SLC20A2or a fragment or derivative thereof binds to a GaLV virus particle. SLC20A2 (see, e.g., Uniprot Accession No. Q08357) is a sodium-phosphate symporter, which confers human cells susceptibility to GaLV. The amino acid sequence of SLC20A2 is: (M)AMDEYLWMVILGFIIAFILAFSVGAND-VANSFGTAVGSGVVTLRQACILASIFETTGS VLL-GAKVGETIRKGIIDVNLYNETVETLMA-GEVSAMVGSAVWQLIASFLRLPISGTHCIV GSTIGFSLVAIGTKGVQWMELVKIVASWFIS- PLLSGFMSGLLFVLIRIFILKKEDPVPNGLR ALPVFYAATIAINVFSIMYTGAPVLGLVLPMWAIAL-ISFGVALLFAFFVWLFVCPWMRR KITGKLQKEG-ALSRVSDESLSKVQEAESPVFKELPGAKANDDSTI-PLTGAAGETLGTSEG TSAGSHPRAAYGRALSMTHGSVKSPIS-NGTFGFDGHTRSDGHVYHTVHKDSGLYKDLL HKI-HIDRGPEEKPAQESNYRLLRRNNSYTCYTAA-ICGLPVHATFRAADSSAPEDSEKLVG DTVSYSKKRLRYDSYSSYCNAVAEAEIE-AEEGGVEMKLASELADPDQPREDPAEEEKEE KDA-PEVHLLFHFLQVLTACFGSFAHGGNDVSNAIG-PLVALWLIYKQGGVTQEAATPVW LLFYGGVGICTGLWVWGRRVIQTMGKDLT-PITPSSGFTIELASAFTVVIASNIGLPVSTTH CKVGSVVAVGWIRSRKAVDWRLFR-NIFVAWFVTVPVAGLFSAAVMALLMYGILPYV (SEQ ID NO: 119).

In some embodiments, a capture domain comprises the extracellular domain of SLC20A2, having an amino acid sequence of SEQ ID NO: 120. In some embodiments, a capture domain comprises SLC20A2 or a fragment or derivative thereof, having an amino acid sequence of SEQ ID NO: 119 with a mutation of Lys-522 to aspartate, glycine, alanine, glutamate, or histidine. In some embodiments, a capture domain comprises SLC20A2 or a fragment or derivative thereof, having an amino acid sequence of SEQ ID NO: 120 with a mutation of Lys-20 to aspartate, glycine, alanine, glutamate, or histidine.

In some embodiments, the capture domain comprising SLC20A2, or a fragment or derivative thereof, comprises an amino acid sequence selected from any one of SEQ ID NOs: 119-120. In some embodiments, the capture domain comprising SLC20A2, or a fragment or derivative thereof, comprises the amino acid sequence of any one of SEQ ID Nos: 119-120 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising SLC20A2, or fragment thereof, comprises a sequence with at least 90%, at least 95%, at least 97%, or at least 99% identity to any one of SEQ ID NOs: 119-120.

In some embodiments, the capture domain binds a coronavirus particle. In some embodiments, the capture domain binds to SARS-COV-2 or SARS-COV. SARS-COV-2 and SARS-COV enter host cells via angiotension-converting enzyme 2 (ACE2).

In some embodiments, a capture domain of a purification matrix provided herein comprises ACE2, or a fragment or derivative thereof. In some embodiments, a capture domain comprising ACE2 or a fragment or derivative thereof binds to a SARS-COV or SARS-COV-2 virus particle. ACE2 (see, e.g., Uniprot Accession No. Q9BYF1) is a carboxypeptidase of the renin-angiotensin hormone system. The amino acid sequence of ACE2 is: (M)SSSSWLLLSLVAVTAAQSTIE-EQAKTFLDKFNHEAEDLFYQSSLASWNYNTNITEEN VQNMNNAGDKWSAFLKEQSTLAQMY-PLQEIQNLTVKLQLQALQQNGSSVLSEDKSKR LNTILNTMSTIYSTGKVCNPDNPQECLLLEPGLNEI-MANSLDYNERLWAWESWRSEVGK QLRPLY-EEYVVLKNEMARANHY-EDYGDYWRGDYEVNGVDGYDYSRGQLIEDVEHTFE EIKPLYEHLHAYVRAKLMNAYPSYISPIGCLPAHL-LGDMWGRFWTNLYSLTVPFGQKPN IDVTDAMVDQAWDAQRIFKE-
AEKFFVSVGLPNMTQGFW-
ENSMLTDPGNVQKAVCHPT AWDLGKGD-
FRILMCTKVTMDDFLTAHHEMGHIQYDMAYAAQ-
PFLLRNGANEGFHEA VGEIMSLSAATPKHLKSIGLL-
SPDFQEDNETEINFLLKQALTIVGTLPFTYMLE-
KWRWMV FKGEIPKDQWMKKWWEMKREIVGVVE-
PVPHDETYCDPASLFHVSNDYSFIRYYTRTLY
QFQFQEALCQAAKHEGPLHKCDISN-
STEAGQKLFNMLRLGKSEPWTLALENVVGAKNM
NVRPLLNYFEPLFTWLKDQNKNSFVGWSTDWSPY-
ADQSIKVRISLKSALGDKAYEWND NEMYL-
FRSSVAYAMRQYFLKVKNQMILFGEEDVRVANLKPR-
ISFNFFVTAPKNVSDIIPR
TEVEKAIRMSRSRINDAFRLNDNSLE-
FLGIQPTLGPPNQPPVSIWLIVFGVVMGVIVVGIVI
LIFTGIRDRKKKNKARSGENPYASIDIS-
KGENNPGFQNTDDVQTSF (SEQ ID NO: 121).

In some embodiments, a capture domain comprises the extracellular domain of ACE2 or a fragment thereof. In some embodiments, a capture domain comprises the extracellular domain of ACE2 or a fragment thereof, having an amino acid sequence of any one of SEQ ID NOs: 122-124. In some embodiments, a capture domain comprises ACE2 or a fragment or derivative thereof, having an amino acid sequence of SEQ ID NO: 121 with one or more mutations selected from K419E, K419D, K419H, K419G, K419A, N89G, and N89A. In some embodiments, a capture domain comprises ACE2 or a fragment or derivative thereof, having an amino acid sequence of SEQ ID NO: 121 with one or more mutations of K31, H34, E35, N90, E208, H374, H378 to any amino acid selected from arginine, lysine, glutamic acid, aspartic acid, histidine, alanine, glycine, serine, threonine, and tryptophan.

In some embodiments, a capture domain comprises ACE2 or a fragment or derivative thereof, having an amino acid sequence of SEQ ID NO: 122 with one or more mutations selected from K403E, K403D, K403H, K403G, K403A, N73G, and N73A. In some embodiments, a capture domain comprises ACE2 or a fragment or derivative thereof, having an amino acid sequence of SEQ ID NO: 123 with one or more mutations selected from K402E, K402D, K402H, K402G, K402A, N72G, and N72A. In some embodiments, a capture domain comprises ACE2 or a fragment or derivative thereof, having an amino acid sequence of SEQ ID NO: 124 with a mutation of N72G or N72A.

In some embodiments, the capture domain comprising ACE2, or a fragment or derivative thereof, comprises an amino acid sequence selected from any one of SEQ ID NOs: 121-124. In some embodiments, the capture domain comprising ACE2, or a fragment or derivative thereof, comprises the amino acid sequence of any one of SEQ ID Nos: 121-124 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising ACE2, or fragment thereof, comprises a sequence with at least 90%, at least 95%, at least 97%, or at least 99% identity to any one of SEQ ID NOs: 121-124.

In some embodiments, the biologic has a size from about 0.001 µm to about 500 µm in diameter or length. In some embodiments, the biologic has a diameter between 1 nm and 100 µm, inclusive of the endpoints. In some embodiments, the biologic has a diameter between 1 nm and 100 nm, inclusive of the endpoints. In some embodiments, the biologic has a diameter between 100 nm and 1 µm, inclusive of the endpoints. In some embodiments, the biologic has a diameter between 1 µm and 50 µm, inclusive of the endpoints. In some embodiments, the biologic has a diameter between 50 µm and 100 µm, inclusive of the endpoints.

In some embodiments, the size (i.e., diameter or length) of the biologic is about 0.001 µm, about 0.002 µm, about 0.003 µm, about 0.004 µm, about 0.005 µm, about 0.006 µm, about 0.007 µm, about 0.008 µm, about 0.009 µm, about 0.010 µm, about 0.020 µm, about 0.030 µm, about 0.040 µm, about 0.050 µm, about 0.060 µm, about 0.070 µm, about 0.080 µm, about 0.090 µm, about 0.1 µm, about 0.2 µm, about 0.3 µm, about 0.4 µm, about 0.5 µm, about 0.6 µm, about 0.7 µm, about 0.8 µm, about 0.9 µm, about 1 µm, about 2 µm, about 3 µm, about 4 µm, about 5 µm, about 6 µm, about 7 µm, about 8 µm, about 9 µm, about 10 µm, about 11 µm, about 12 µm, about 13 µm, about 14 µm, about 15 µm, about 16 µm, about 17 µm, about 18 µm, about 19 µm, about 20 µm, about 21 µm, about 22 µm, about 22 µm, about 23 µm, about 24 µm, about 25 µm, about 26 µm, about 27 µm, about 28 µm, about 29 µm, about 30 µm, about 31 µm, about 32 µm, about 33 µm, about 34 µm, about 35 µm, about 36 µm, about 37 µm, about 38 µm, about 39 µm, about 40 µm, about 41 µm, about 42 µm, about 43 µm, about 44 µm, about 45 µm, about 46 µm, about 47 µm, about 48 µm, about 49 µm, about 50 µm, about 55 µm, about 60 µm, about 65 µm, about 70 µm, about 75 µm, about 80 µm, about 85 µm, about 90 µm, about 95 µm, about 100 µm, about 150 µm, about 200 µm, about 250 µm, about 300 µm, about 350 µm, about 400 µm, about 450 µm, or about 500 µm, or greater, including all values and ranges in between. In some embodiments, the biologic has a size of greater than or equal to 10 µm. In some embodiments, the biologic has a size that is greater than or equal to 25 µm. In some embodiments, the biologic has a size that is greater than or equal to 50 µm. In some embodiments, the biologic has a size that is greater than or equal to 100 µm.

In some embodiments, the biologic has a size (i.e., molar mass) from about 2 kDa to about 1000 MDa. In some embodiments, the biologic has a molar mass of about 2 kDa, about 5 kDa, about 15 kDa, about 20 kDa, about 20 kDa, about 25 kDa, about 30 kDa, about 35 kDa, about 40 kDa, about 45 kDa, about 50 kDa, about 55 kDa, about 60 kDa, about 65 kDa, about 70 kDa, about 75 kDa, about 80 kDa, about 85 kDa, about 90 kDa, about 95 kDa, about 100 kDa, about 150 kDa, about 200 kDa, about 250 kDa, about 300 kDa, about 350 kDa, about 400 kDa, about 450 kDa, about 500 kDa, about 550 kDa, about 600 kDa, about 650 kDa, about 700 kDa, about 750 kDa, about 800 kDa, about 850 kDa, about 900 kDa, about 950 kDa, about 1000 kDa, about 1 MDa, about 5 MDa, about 10 MDa, about 15 MDa, about 20 MDa, about 25 MDa, about 50 MDa, about 75 MDa, about 100 MDa, about 125 MDa, about 150 MDa, about 175 MDa, about 200 MDa, about 225 MDa, about 250 MDa, about 275 MDa, about 300 MDa, about 325 MDa, about 350 MDa, about 400 MDa, about 425 MDa, about 450 MDa, about 500 MDa, about 550 MDa, about 600 MDa, about 650 MDa, about 700 MDa, about 750 MDa, about 800 MDa, about 850 MDa, about 900 MDa, about 950 MDa, or about 1000 MDa, including all values and ranges therebetween.

In some embodiments, the capture domain comprises an amino acid sequence selected from the group consisting of:

(a) VDNKFNKEQQNAFYEILHLPNLNEEQR-
NAFIQSLKDDPSQSANLLAEAKK LNDAQAPK
(SEQ ID NO: 24);

(b) VDNKFNKEQQNAFYEILSLPNLNEEQRAAF-IQSLKDDPSQSANLLAEAKK LNDAQAPKG (SEQ ID NO: 25)

(c) VDNKFNKEHQNAFYEILHLPNLNEEQR-NAFIQSLKHDPSQSANLLAEAKK LNDAQAPKG (SEQ ID NO: 26);

(d) AQHDEAQQNAFYQVLNMPNLNADQRNG-FIQSLKDDPSQSANVLGEAQK LNDSQAPKADAQQNKFNKDQQSAFYEILNMPNL-NEEQRNGFIQSLKDDPSQSTNVLGE AKKL-NESQAPKADNNFNKEQQNAFYEILNMPNLNE-EQRNGFIQSLKDDPSQSANLLAEA KKLNESQAPKADNKFNKEQQNAFYEILHLPNL-NEEQRNGFIQSLKDDPSQSANLLAEAK KLN-DAQAPKADNKFNKEQQNAFYEILHLPN (SEQ ID NO: 27);

(e) TYKLILNGKTLKGETTTEAVDAATAEKVFKQY-ANDNGVDGEWTYDDAT KTFTVTEG (SEQ ID NO: 28);

(f) KTDTYKLILNGKTLKGETTTEAVDAA-TAEKVFKQYANDNGVDGEWTYD DATKTFTVTEKPEVIDASELTPAVTTYKL VINGKTLKGETTTKAVDAETAEKAFKQYAN DNGVDGVWTYDDATKTFTVTEMVTE-VPGDAPTEPEKPEASIPLVPLTPATPIAKDDAKK DDTKKEDAKKPEAKKDDAKKAET (SEQ ID NO: 29);

(g) KEETPETPETDSEEEVTIKANLIFANGSTQ-TAEFKGTFEKATSEAYAY ADTLKKDNGEYTVD-VADKGYTLNIKFAG (SEQ ID NO: 30);

(h) GYVS (R/H/K) (R/H) (P/S) (SEQ ID NO: 31);

(i) SDVQLQESGPDLVKP-SQSLSLTCTVTGYSITSGYT-WHWIRQFPGNKQEWG YIHFSGYTNYNPSLKSRVSITRDTSKNQF-FLHLNSVTTEDTATYYCARGDYGYEWFTYW GQGTLVTVSADIQMTQSSSSFSVSLGDRVTITCK-ASEDIHNRLAWYKQKPGNAPRLLISG ATS-LETGVPSRFSGSGSGKDYTLSITSLQNED-VATYYCQQYWIGPFTFGSGTNLEIK (SEQ ID NO: 32)

(j) GYVSRHPGGGC (SEQ ID NO: 33);

(k) GYVSRHPGGGGS (SEQ ID NO: 34);

(l) FHENWPSGGGC (SEQ ID NO: 35);

(m) FHENWPSGGGGS (SEQ ID NO: 36);

(n) GVVTINP (SEQ ID NO: 37);

(o) GLVTPSG (SEQ ID NO: 38);

(p) GYVSHRS (SEQ ID NO: 39);

(q) KVWILTP (SEQ ID NO: 40);

(r) KLWVIPQ (SEQ ID NO: 41)

(s) GVSAGESVQITLPKNEVQLNAYVLQEPPKGETY-TYDWQLITHPRDYSGE MEGKHSQILKLSKLTPG-LYEFKVIVEGQNAHGEGYVNVTVKPEPRKNRP-PIAIVSPQFQE ISLPTTSTVIDGSQSTDDDKIVQYHWEELKGPL-REEKISEDTAILKLSKLVPGNYTFSLTV VDSD-GATNSTTANLTVNKAVDYPP-VANAGPNQVITLPQNSITLFGNQSTDDHGITS-YEW SLSPSSKGKVVEMQGVRTPTLQL-SAMQEGDYTYQLTVTDTIGQQATAQVTVIVQ-PENN KPPQADAGPDKELTLPVDSTTLDG-SKSSDDQKIISYLWEKTQGPDGVQLENANSS-VATV TGLQVGTYVFTLTVKDERNLQSQSSVN-VIVKEEINKPPIAKITGNVVITLPTSTAELDGSK SSDDKGIVSYLWTRDEGSPAAGEVLNHSDHH-PILFLSNL VEGTYTFHLKVTDAKGESDT DRTTVEVKPDPRG (SEQ ID NO: 42)

(t) SAGESVQITLPKNEVQLNAYVLQEPPKGETYTY-DWQLITHPRDYSGEMEG KHSQILKLSKLTPGLY-EFKVIVEGQNAHGEGYVNVTVKPE (SEQ ID NO: 43)

(u) IAIVSPQFQEISLPTTSTVIDGSQSTDDD-KIVQYHWEELKGPLREEKISEDTA ILKLSK-LVPGNYTFSLTVVDSDGATNSTTANLTVNKA (SEQ ID NO: 44)

(v) MGVSAGESVQITLPKNEVQLNAY-VLQEPPKGETYTYDWQLITHPRDYSG EMEGKHSQILKLSKLTPGLYEFKVIVEGQNAHG-EGYVNVTVKPEPRKNRPPIAIVSPQFQ EISLPTT-STVIDGSQSTDDDKIVQYHWEELKGPLREEKI-SEDTAILKLSKLVPGNYTFSLTV VDSDGATNSTTANLTVNKA (SEQ ID NO: 45)

(w) VANAGPNQVITLPQNSITLFGNQSTDDHGIT-SYEWSLSPSSKGKVVEMQG VRTPTLQL-SAMQEGDYTYQLTVTDTIGQQATAQVTVIVQPE (SEQ ID NO: 46)

(x) QADAGPDKELTLPVDSTTLDGSKSSDDQKII-SYLWEKTQGPDGVQLENAN SSVATVTGLQVGTYVFTLTVKDERNLQSQSSVN-VIVKEE (SEQ ID NO: 47)

(y) IAKITGNVVITLPTSTAELDGSKSSDDKGIV-SYLWTRDEGSPAAGEVLNHS DHHPILFLSNL VEGTYTFHLKVTDAKGESDTDRTTVEVKPDP (SEQ ID NO: 48), and (z) LAEAKVLANRELDKYGVSDYYKNLINNA-KTVEGVKALIDEILAALP (SEQ ID NO: 49).

In some embodiments, the capture domain comprises an amino acid sequence selected from any one of SEQ ID Nos: 24-49,62-148, 167-171. In some embodiments, the capture domain comprises an amino acid sequence with at least 90%, at least 95%, at least 96%, at least 97%, at least 98%, at least 99% identity to any one of SEQ ID Nos: 24-49, 62-148, and 167-171.

In some embodiments, the capture domain comprises an amino acid sequence lacking the N-terminal methionine of any one of SEQ ID Nos: 24-49, 62-148, and 167-171.

In some embodiments, the capture domain binds a contaminant. In some embodiments, the contaminant is a biologic. In some embodiments, the contaminant is selected from the group consisting of a solvent, an endotoxin, a protein, a peptide, a nucleic acid, a virus, and a carbohydrate.

In some embodiments, the capture domain comprises a signal peptide.

In some embodiments, the number of capture domains within a protein-based purification matrix ranges from 1 to about 100. In some embodiments, the number of capture domains is about 1, about 5, about 10, about 20, about 30, about 40, about 50, about 55, about 60, about 65, about 70, about 75, about 80, about 85, about 90, about 95, or about 100. In some embodiments, a single polypeptide with phase behavior may be coupled to multiple capture domains, such as about 1 to 100 capture domains.

In some embodiments, a protein-based purification matrix may have two or more capture domains that each individually bind to different biologics, contaminants, or other molecules.

In some embodiments, the affinity of a capture domain for a biologic, contaminant, and/or other molecule is modulated to facilitate separation of the biologic from the protein-based purification matrix.

In some embodiments, the capture domain is selected from the group consisting of protein A, protein G, and protein L, or a fragment or derivative thereof. In some embodiments, the capture domain is an antibody or fragment thereof (e.g., a Fab). In some embodiments, the antibody fragment thereof is a single-chain variable fragment.

Polypeptides with Phase Behavior

The compositions and methods disclosed herein may employ one or more polypeptides with phase behavior.

In some embodiments, the polypeptide with phase behavior is a resilin-like polypeptide (RLP). Resilin-like polypeptides are elastomeric polypeptides with mechanical properties including desirable resilience, compressive elastic modulus, tensile elastic modulus, shear modulus, extension to break, maximum tensile strength, hardness, rebound, and compression set. In some embodiments, the resilin-like polypeptides described herein are polymers which comprise one or more repeats. In some embodiments, the polymeric repeats may have an amino acid sequence selected from any one of SEQ ID NOS: 1-9.

In some embodiments, a resilin-like polypeptide comprises more than one type of repeat, e.g. a repeat of SEQ ID NO: 1 and a repeat of SEQ ID NO: 3.

In some embodiments, the resilin-like polypeptides described herein comprise repeats that occur up to 500 times within a given RLP. In some embodiments, the repeats occur about 1, about 2, about 3, about 4, about 5, about 6, about 7, about 8, about 9, about 10, about 20, about 30, about 40, about 50, about 60, about 70, about 80, about 90, about 100, about 110, about 120, about 130, about 140, about 150, about 160, about 170, about 180, about 190, about 200, about 210, about 220, about 230, about 240, about 250, about 260, about 270, about 280, about 290, about 300, about 310, about 320, about 330, about 340, about 350, about 360, about 370, about 380, about 390, about 400, about 450, or about 500 times.

In some embodiments, the RLP comprises one or more partial repeats. In some embodiments, the length of a partial repeat is 1, 2, 3, 4, 5, 6, 7, 8, 9, 10, or more amino acids. In some embodiments, the RLP comprises one or more additional amino acids at the N-terminus or C-terminus of the RLP that are not part of a repeat.

In some embodiments, one or more RLP repeats are scrambled, i.e., they contain a different amino acid sequence but retain the same amino acid composition. For example, a repeat may have a different amino acid sequence than SEQ ID NO: 8, but retain the same amino acid composition.

In some embodiments, the polypeptide with phase behavior is an elastin-like polypeptide. Elastin-like polypeptides (ELPs) are biopolymers derived from tropoelastin. In some embodiments, the elastin-like polypeptides described herein are polymers comprising a pentapeptide repeat having the sequence (Val-Pro-Gly-Xaa-Gly)$_n$ (SEQ ID NO: 189). In some embodiments, n is 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, or 500, including all values and ranges in between.

In some embodiments, the pentapeptide repeat is scrambled, for example it comprises a different amino acid sequence but maintains the same amino acid composition. For example, an ELP may comprise a different amino acid sequence than SEQ ID NO: 189, but maintains the same amino acid composition, e.g. 40% of the sequence is glycine, 20% of the sequence is Xaa, 20% of the sequence is proline, and 20% of the sequence is valine.

In some embodiments, the ELP comprises one or more partial repeats. In some embodiments, the length of a partial repeat is 1, 2, 3, or 4 amino acids. In some embodiments, the ELP comprises one or more additional amino acids at the N-terminus or C-terminus of the ELP that are not part of a repeat.

ELPs and RLPs undergo a phase transition in response to an environmental factor. ELPs and RLPs retain their ability to undergo a phase transition when coupled to one or more polypeptides (such as one or more capture domains), or expressed as a fusion protein with one or more other polypeptides (such as one or more capture domains). Polymers like ELPs and RLPs exhibit a transition temperature ($T_t$), also referred to as a cloud point temperature (Tc). In some embodiments ELPs and RLPs undergo a reversible phase transition from a soluble to an insoluble phase at the $T_t$. ELPs that transition from a soluble to an insoluble phase with heating or an increase in salt concentration have a $T_t$ referred to as a lower critical solution temperature (LCST). RLPs that transition from a soluble to an insoluble phase with cooling or a decrease in salt concentration have a $T_t$ referred to as a lower critical solution temperature (UCST). In some embodiments, the phase transition results from a change in secondary structure of the ELP and/or RLP. For example, the phase transition of an ELP results from a change in secondary structure from a random coil (below the $T_t$) to a type II β-turn. In some embodiments, the change in secondary structure is characterized by a method selected from circular dichroism spectropolarimetry, small angle x-ray scattering, and cryo-electron microscopy, ultraviolet-visible spectrophotometry, static light scattering, dynamic light scattering, nuclear magnetic resonance spectroscopy, solid-state nuclear magnetic resonance spectroscopy, infra-red spectroscopy, Fourier transform infrared spectroscopy (FTIR), microscopy, and small angle neutron scattering. In some embodiments, the phase transition of an ELP does not result from a chance in secondary structure.

In some embodiments, the RLPs and ELPs described herein have a transition temperature between about 0° C. and about 100° C. In some embodiments, the RLPs and ELPs described herein have a transition temperature between about 10° C. and about 50° C. In some embodiments the transition temperature is about 0° C., about 1° C., about 2° C., about 3° C., about 4° C., about 5° C., about 6° C., about 7° C., about 8° C., about 9° C., about 10° C., about 11° C., about 12° C., about 13° C., about 14° C., about 15° C., about 16° C., about 17° C., about 18° C., about 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., about 37° C., about 38° C., about 39° C., about 40° C., about 41° C., about 42° C., about 43° C., about 44° C., about 45° C., about 46° C., about 47° C., about 48° C., about 49° C., about 50° C., about 51° C., about 52° C., about 53° C., about 54° C., about 55° C., about 56° C., about 57° C., about 58° C., about 59° C., about 60° C., about 61° C., about 62° C., about 63° C., about 64° C., about 65° C., about 66° C., about 67° C., about 68° C., about 69° C., about 70° C., about 71° C., about 72° C., about 73° C., about 74° C., about 75° C., about 76° C., about 77° C., about 78° C., about 79° C., about 80° C., about 81° C., about 82° C., about 83° C., about 84° C., about 85° C., about 86° C., about 87° C., about 88° C., about 89° C., about 90° C., about 91° C., about 92° C., about 93° C., about 94° C., about 95° C., about 96° C., about 97° C., about 98° C., about 99° C., or about 100° C. In some embodiments, the RLPs described herein have a transition temperature from about 10° C. to about 100° C.

In some embodiments, the $T_t$ of the RLPs and ELPs described herein is modulated by manipulating the primary structure e.g. amino acid sequence of the RLP and ELP. In some embodiments, the hydrophobicity of the ELP or RLP is modulated. In some embodiments, the hydrophobicity of the ELP is modified by altering the identity of the guest residue Xaa. In some embodiments, the hydrophobicity of the ELP or RLP is increased resulting in a decreased $T_t$. In some embodiments, the hydrophobicity of the ELP or RLP is decreased resulting in an increased $T_t$. In some embodiments, the polarity of the ELP or RLP is modulated. In some embodiments, the polarity of the ELP is modulated by altering the identity of the guest residue Xaa. In some embodiments, the polarity of the ELP or RLP is increased resulting in an increased $T_t$. In some embodiments, the polarity of the ELP or RLP is decreased resulting in a decreased $T_t$.

In some embodiments, the number of ELP pentapeptide repeats (n) is modulated to alter the $T_t$. In some embodiments, n of the pentapeptide repeat (Val-Pro-Gly-Xaa-Gly)$_n$ (SEQ ID NO: 189) is an integer from 1 to 500, inclusive of endpoints. In some embodiments, n is 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, or 500, including all values and ranges in between.

In some embodiments, Xaa also referred to herein as "the guest residue" is any amino acid that does not eliminate the phase behavior of the ELP. In some embodiments, Xaa is any amino acid except proline. In some embodiments, Xaa is independently selected for each repeat. For example, a given ELP may contain the guest residues alanine, glycine, and valine at a ratio of 8:7:1. In some embodiments Xaa is selected from the group consisting of alanine, arginine, asparagine, aspartic acid, cysteine, glutamic acid, glutamine, glycine, histidine, isoleucine, leucine, lysine, methionine, phenylalanine, praline, serine, threonine, tryptophan, tyrosine and valine. In some embodiments, Xaa is a non-classical amino acid selected from Table 2 and/or the group consisting of 2,4-diaminobutyric acid, α-amino-isobutyric acid, alloisoleucine, 4-aminobutyric acid, 2-amino butyric acid (Abu), γ-Abu, ε-Ahx, 6-amino hexanoic acid, 2-amino isobutyric acid (Aib), 3-amino propionic acid, ornithine, norleucine, norvaline, hydroxyproline, sarcosine, citrulline, homocitrulline, cysteic acid, t-butylglycine, t-butylalanine, phenylglycine, cyclohexylalanine, β-alanine, fluoro-amino acids, designer amino acids such as β-methyl amino acids, Cα-methyl amino acids, Na-methyl amino acids, and amino acid analogs in general. In some embodiments, Xaa is the D-isomer of a natural or non-classical amino acid.

In some embodiments, the $T_t$ of the RLPs and ELPs described herein is modulated by introducing one or more environmental factors to the composition containing the RLP and/or ELP. In some embodiments, the $T_t$ of the ELPs and/or RLPs is modulated by adjusting the ionic strength of solvents. In some embodiments, the ionic strength of the solvent is adjusted by adding salt. In some embodiments, ELPs and/or RLPs contain lower $T_t$ in solvents containing anions categorized as kosmotropes. Anions that are kosmotropes are highly hydrated and influence the water shield on ELPs and/or RLPs. In some embodiments, the $T_t$ of ELPs and/or RLPs can be adjusted through the addition of anions that are chaotropes. At low concentrations, the addition of chaotropes increase the $T_t$ of the ELP and/or RLP. At high concentrations, the addition of a chaotrope decreases the $T_t$ of the ELP and/or RLP. In some embodiments, the $T_t$ of the ELP and/or RLP can be tuned by introducing one or more reagents that disrupts hydrogen bonds. Non-limiting examples of reagents that disrupt hydrogen bonds include sodium dodecyl sulfate (SDS) and urea. In some embodiments, reagents that enhance hydrogen bond formation are utilized to modulate the $T_t$. In some embodiments, reagents that enhance hydrophobic interactions are utilized to modulate the $T_t$. Trifluoroethanol is a reagent which enhances both hydrophobic interactions and hydrogen bond formation, causing a decrease in $T_t$.

In some embodiments, the ELP and/or RLP concentration can be adjusted to modulate $T_t$. In some embodiments, a higher ELP and/or RLP concentration results in a reduced $T_t$. In some embodiments, a lower ELP and/or RLP concentration results in an increased $T_t$.

In addition, modulation of pH, light, and ion concentrations also can be utilized to modulate $T_t$.

In some embodiments, modulation of the number of (e.g. addition or removal) charged amino acids (e.g. histidine, lysine, arginine, glutamic acid, aspartic acid, ornithine, or other non-natural charged amino acids) and identity (e.g. positively or negatively charged) enables tuning of the $T_t$ through pH modulation.

In some embodiments, the ELPs and/or RLPs described herein are block copolymers. A block copolymer comprises two or more sequence domains or blocks, in which two or more blocks contain different properties. Non-limiting examples of properties that can be tuned include hydrophilicity, hydrophobicity, polarity, and secondary structure. In some embodiments, the block copolymer is an amphiphile, e.g. it comprises at least one hydrophobic and at least one hydrophilic block.

In some embodiments, the ELPs and/or RLPs described herein assemble into various morphologies. Non-limiting examples of morphologies include a spherical aggregate, a micelle, a vesicle, a fibril, a nanofibril, a nanotube, and a hydrogel. In some embodiments, the RLPs and/or ELPs described herein assemble into various morphologies after the addition of an environmental factor. In some embodiments, the RLPs and/or ELPs described herein change from one morphology to another morphology after the addition of an environmental factor. In some embodiments, the RLPs and/or ELPs described herein change from one morphology to another morphology after the addition of a biologic.

In some embodiments, addition of an environmental factor causes an RLP and/or ELP to undergo a phase transition. In some embodiments, at the RLP and/or ELP phase transition, the RLP and/or ELP converts from one morphology to another morphology.

In some embodiments, a phase transition of an RLP and/or ELP causes the formation of dense, liquid, droplets.

In some embodiments, the polypeptide with phase behavior comprises an amino acid sequence selected from the group consisting of:

(a) $(GRGDSPY)_n$ (SEQ ID NO: 180)

(b) $(GRGDSPH)_n$ (SEQ ID NO: 181)

(c) $(GRGDSPV)_n$ (SEQ ID NO: 182)

(d) $(GRGDSPYG)_n$ (SEQ ID NO: 183)

(e) $(RPLGYDS)_n$ (SEQ ID NO: 184)

(f) $(RPAGYDS)_n$ (SEQ ID NO: 185)

(g) $(GRGDSYP)_n$ (SEQ ID NO: 186)

(h) $(GRGDSPYQ)_n$ (SEQ ID NO: 187)

(i) $(GRGNSPYG)_n$ (SEQ ID NO: 188)

(j) $(GVGVP)_n$ (SEQ ID NO: 190);

(k) $(GVGVPGLGVPGVGVPGLGVPGVGVP)_m$ (SEQ ID NO: 12);

(l) $(GVGVPGVGVPGAGVPGVGVPGVGVP)_m$ (SEQ ID NO: 13);

(m) $(GVGVPGWGVPGVGVPGWGVPGVGVP)_m$ (SEQ ID NO: 14);

(n) $(GVGVPGVGVPGVGVPGVGVPGVGVPGVGVPGEGVPGFGVPGVGVP)_m$ (SEQ ID NO: 15);

(o) $(GVGVPGVGVPGVGVPGVGVPGVGVPGVGVPGKGVPGFGVPGVGVP)_m$ (SEQ ID NO: 16); and (p) $(GAGVPGVGVPGAGVPGVGVPGAGVP)_m$ (SEQ ID NO: 17);

or a randomized, scrambled analog thereof;

wherein:

n is an integer in the range of 1-500, inclusive of endpoints; and m is an integer in the range of 4-25, inclusive of endpoints.

In some embodiments, the polypeptide with phase behavior comprises an amino acid sequence of $(GVGVPGVGVPGAGVPGVGVPGVGVP)_m$ (SEQ ID NO: 53) or $(GVGVPGVGVPGLGVPGVGVPGVGVP)_m$ (SEQ ID NO: 55), wherein m is an integer between 2 and 32, inclusive of endpoints. In some embodiments, the polypeptide with phase behavior comprises an amino acid sequence of $(GVGVPGVGVPGAGVPGVGVPGVGVP)_m$ (SEQ ID NO: 193), wherein m is 8 or 16. In some embodiments, the polypeptide with phase behavior comprises an amino acid sequence of $(GVGVPGAGVP)_m$ (SEQ ID NO: 54), wherein m is an integer between 5 and 80, inclusive of endpoints. In some embodiments, the polypeptide with phase behavior comprises an amino acid sequence of $(GXGVP)_m$ (SEQ ID NO: 56), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

In some embodiments, the polypeptide with phase behavior comprises an amino acid sequence selected from (a) $(GVGVP)_m$ (SEQ ID NO: 52);

(b) $(ZZPXXXXGZ)_m$ (SEQ ID NO: 57);

(c) $(ZZPXGZ)_m$ (SEQ ID NO: 58);

(d) $(ZZPXXGZ)_m$ (SEQ ID NO: 59); and (e) $(ZZPXXXGZ)_m$ (SEQ ID NO: 60), wherein m is an integer between 10 and 160, inclusive of endpoints, wherein X if present is any amino acid except proline or glycine, and wherein Z if present is any amino acid.

In some embodiments, the polypeptide with phase behavior comprises an amino acid sequence of $(GVGVP)_m$ (SEQ ID NO: 192), wherein m is 20, 40, or 80. In some embodiments, the polypeptide with phase behavior comprises an amino acid sequence of $(GRGDXPZX)_m$ (SEQ ID NO: 61) or $(XZPXDGRG)_m$ (SEQ ID NO: 51), wherein X is glutamine or serine, Z is tyrosine or valine, and m is an integer between 10 and 160, inclusive of endpoints.

In some embodiments, the polypeptide with phase behavior comprises a first set of repeat sequences and a second set of repeat sequences. The first set of repeat sequences and the second set of repeat sequences may each individually comprise sequences that are repeated one or more times. In some embodiments, the first set of repeat sequences any/or the second set of repeat sequences comprises a repeating sequence comprising any one of SEQ ID NOs: 1-17 and 51-61. In some embodiments, the polypeptide with phase behavior comprises a first set of repeat sequences and a second set of repeat sequences, wherein the first set of repeat sequences comprises the amino acid sequence of $(GRGDXPZX)_{40}$ (SEQ ID NO: 149) and the second set of repeat sequences comprises the amino acid sequence $(GVGVP)_{80}$ (SEQ ID NO: 150), wherein X is glutamine and Z is tyrosine. In some embodiments, polypeptide with phase behavior comprising a first set of repeat sequences and a second set of repeat sequences comprises the sequence of SEQ ID NO: 151 In some embodiments, the polypeptide with phase behavior comprises at least one, at least two, at least three, at least four, at least five, at least six, at least seven, at least eight, at least nine, or at least ten different sets of repeat sequences. In some embodiments, each set of repeat sequences within the polypeptide with phase behavior comprises sequences that repeat from about 5 to about 400 times, for example, about 5, about 10, about 15, about 20, about 25, about 30, about 35, about 40, about 45, about 50, about 55, about 60, about 65, about 70, about 75, about 80, about 85, about 90, about 95, about 100, about 105, about 110, about 115, about 120, about 125, about 130, about 135, about 140, about 145, about 150, about 155, about 160, about 165, about 170, about 175, about 180, about 185, about 190, about 195, about 200, about 205, about 210, about 215, about 220, about 225, about 230, about 235, about 240, about 245, about 250, about 255, about 260, about 265, about 270, about 275, about 280, about 285, about 290, about 295, about 300, about 305, about 310, about 315, about 320, about 325, about 330, about 335, about 340, about 345, about 350, about 355, about 360, about 365, about 370, about 375, about 380, about 385, about 390, about 395, or about 400 times.

In some embodiments, the polypeptide with phase behavior comprising an amino acid sequence selected from any one of SEQ ID NOs: 1-17 and 51-61 also comprises up to 10 additional N-terminal and/or C-terminal amino acids. In some embodiments, the polypeptide with phase behavior comprising an amino acid sequence of any one of SEQ ID NOs: 1-17 and 51-61 also comprises an additional N-terminal methionine. In some embodiments, the polypeptide with phase behavior comprising an amino acid sequence of any one of SEQ ID NOs: 1-17 and 51-61 also comprises an additional C-terminal glycine.

In some embodiments, the polypeptide with phase behavior has the same amino acid composition of an ELP and/or RLP but does not contain repeats. In some embodiments, the polypeptide with phase behavior comprises an amino acid sequence that is 80%, about 85%, about 90%, about 95%, about 96%, about 97%, about 98%, about 99%, or about 100% identical to an ELP and/or RLP. In some embodiments, the polypeptide with phase behavior comprises an amino acid composition that is 80%, about 85%, about 90%, about 95%, about 96%, about 97%, about 98%, about 99%, or about 100% identical to an ELP and/or RLP. In some embodiments, the polypeptide with phase behavior comprises a composition of hydrophobic amino acids that is 80%, about 85%, about 90%, about 95%, about 96%, about 97%, about 98%, about 99%, or about 100% identical to an ELP and/or RLP.

In some embodiments, the polypeptide with phase behavior comprises a non-repetitive unstructured polypeptide. In some embodiments, the non-repetitive unstructured polypeptide has an amino acid sequence that contains at least 50 amino acids. In some embodiments, the non-repetitive unstructured polypeptide has an amino acid sequence that contains at least 50, at least 60, at least 70, at least 80, at least 90, or at least 100 amino acids. In some embodiments, the sequence of the non-repetitive unstructured polypeptide is at least about 10% proline (e.g. at least 10%, 20%, 30%, 40%, 50%, 60%, 70%, or 80%) and at least 20% glycine (e.g. at least 20%, at least 30%, at least 40%, at least 50%, at least 60%, at least 70%, at least 80%, or at least 90%). In some embodiments, the non-repetitive unstructured polypeptide has a sequence that contains at least about 40% of amino acids selected from the group consisting of valine, alanine, leucine, lysine, threonine, isoleucine, tyrosine, serine, and phenylalanine.

In some embodiments, the non-repeated unstructured polypeptide comprises a sequence that does not contain three contiguous identical amino acids, wherein any 5-10 amino acid subsequence does not occur more than once in the non-repeated unstructured polypeptide, and wherein when the non-repeated unstructured polypeptide comprises a subsequence starting and ending with proline, and wherein the subsequence further comprises at least one glycine.

In some embodiments, the ELPs and/or RLPs described herein are expressed as a component of a fusion protein. In some embodiments, the fusion protein is expressed in bacteria or mammalian cells. In some embodiments, the fusion protein is expressed in *Escherichia coli*. In some embodiments, the fusion protein is expressed in insect cells. In some embodiments, the sequence of the non-repetitive unstructured polypeptide is at least about 10% proline (e.g. at least 10%, 20%, 30%, 40%) and at least 20% glycine (e.g. at least 20%, 30%, 40%, or 50%), and at least 40% (e.g. at least 40%, 50%, 60%, or 70%) of amino acids selected from the group consisting of valine, alanine, leucine, lysine, threonine, isoleucine, tyrosine, serine, and phenylalanine.

In some embodiments, the non-repetitive unstructured polypeptide does not contain three contiguous identical amino acids. In some embodiments, the non-repetitive unstructured polypeptide comprises a subsequence (e.g. a fragment of the non-repetitive unstructured polypeptide) which only occurs once in the non-repetitive unstructured polypeptide sequence. In some embodiments, the non-repetitive unstructured polypeptide comprises a subsequence that starts and ends with proline. In some embodiments, the non-repetitive unstructured polypeptide comprises a subsequence that contains at least one glycine.

In some embodiments, the polypeptide with phase behavior comprises a signal peptide.

In some embodiments, the polypeptide with phase behavior comprises an amino acid sequence of (GVGVPGLGVPGVGVPGLGVPGVGVP)$_m$ (SEQ ID NO: 191), wherein m is 16. In some embodiments, the polypeptide with phase behavior comprises an amino acid sequence of SEQ ID NO: 164. In some embodiments, the polypeptide with phase behavior comprises an amino acid sequence of SEQ ID NO: 165.

Linkers Between Polypeptides with Phase Behavior and Capture Domains

In some embodiments, the capture domain is coupled to the polypeptide with phase behavior via a linker. In some embodiments, any linker that does not interfere with the function of the purification matrix may be utilized.

In some embodiments, the linker connects the capture domain to the polypeptide with phase behavior. In some embodiments, the linker enables cooperative interactions between the polypeptide with phase behavior and the capture domain. In some embodiments, the linker is a peptide. In some embodiments, the linker preserves the phase behavior of the polypeptide with phase behavior. In some embodiments, the linker preserves the T$_t$ of the polypeptide with phase behavior. In some embodiments, the linker preserves the structure of the capture domain. In some embodiments, the linker comprises between 1 and 50 amino acids. In some embodiments, the linker comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 amino acids.

In some embodiments, the stiffness of the linker is increased by the inclusion of proline in the linker amino acid sequence.

In some embodiments, the flexibility of a linker is increased by the inclusion of small polar amino acids, including threonine, serine, and glycine.

In some embodiments, the linker may adopt various secondary structures, including but not limited to α-helices, β-strands, and random coils. In some embodiments, the linker adopts an a-helix and comprises an amino acid repeat of (EAAAK)$_n$ (SEQ ID NO: 18) where n is a repeat number, i.e., an integer in the range of 1 to 20, inclusive of endpoints.

In some embodiments, the linker is comprised of (G$_4$S)$_n$ (SEQ ID NO: 19) where n can be an integer from 1 to 30 (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30). In embodiments, the polypeptide linker has a repeat of (SGGG)n (SEQ ID NO: 20), wherein n is an integer from 1 to 50 (e.g. 1, 2, 3, 4, 5, 6, 7, 8, 9, 10, 11, 12, 13, 14, 15, 16, 17, 18, 19, 20). In embodiments, the polypeptide linker has a repeat of (GGGS)$_n$ (SEQ ID NO: 21), wherein n is an integer from 1 to 20 (e.g. 1, 2, 3, 4, 5, 6, 7, 8, 9, 10, 11, 12, 13, 14, 15, 16, 17, 18, 19, or 20).

In some embodiments, the linker has an amino acid sequence of KESGSVSSEQLAQFRSLD (SEQ ID NO: 22). In some embodiments, the linker has an amino acid sequence of EGKSSGSGSESKST (SEQ ID NO: 23). In some embodiments, the linker only contains glycine.

In some embodiments, the peptide linker comprises a protease cleavage site. In some embodiments, the protease cleavage site is a furin cleavage site.

In some aspects, the polypeptide linker is a poly-(Gly)$_n$ linker, wherein n is an integer from 1 to 30 (e.g., 1, 2, 3, 4, 5, 6, 7, 8, 9, 10, 15, 16, 17, 18, 19, 20, 21, 22, 23, 24, 25, 26, 27, 28, 29, or 30 (SEQ ID NO: 50). In other embodiments, the linker is selected from the group consisting of: dipeptides, tripeptides, and quadripeptides. In embodiments, the linker is a dipeptide selected from the group consisting of alanine-serine (AS), leucine-glutamic acid (LE), and serine-arginine (SR).

In some embodiments, the linker is selected from GKSSGSGSESKS (SEQ ID NO: 152), GST-SGSGKSSEGKG (SEQ ID NO: 153), GST-SGSGKSSEGSGSTKG (SEQ ID NO: 154), GST-SGSGKPGSGEGSTKG (SEQ ID NO: 155), EGKSSGSGSESKEF (SEQ ID NO: 156), SRSSG (SEQ ID NO: 157), and SGSSC (SEQ ID NO: 158).

In some embodiments, the linker is a self-cleaving peptide. In some embodiments, the self-cleaving peptide is a 2A peptide. 2A peptides are a class of 18-22 amino acid long peptides that induce ribosomal skipping during translation of a protein in a cell. In some embodiments, the 2A peptide is a T2A peptide having an amino acid sequence of EGRGSLLTCGDVEENPGP (SEQ ID NO: 159), a P2A peptide having an amino acid sequence of ATNFSLLKQAGDVEENPGP (SEQ ID NO: 160), an E2A peptide having an amino acid sequence of QCTNYALLKLAGDVESNPGP (SEQ ID NO: 161), or an F2A peptide having an amino acid sequence of VKQTLNFDLLKLAGDVESNPGP (SEQ ID NO: 162). In some embodiments, the 2A peptide has at least 80%, at least 85%, at least 90%, at least 95%, or at least 98% identity to any one of SEQ ID NOs. 159-162. In some embodiments, the 2A peptide further comprises GSG (SEQ ID NO: 163) on its N-terminus.

In some embodiments, the linker is a chemical linker. In some embodiments, the chemical linker is selected from the group consisting of a carbohydrate linker, a lipid linker, a fatty acid linker, and a polyether linker.

In some embodiments, the linker is a direct covalent linkage between an amino acid residue of the polypeptide with an amino acid residue of the polypeptide with phase behavior and a capture domain. In some embodiments, a fusion protein comprises the polypeptide with phase behavior and a capture domain. In some embodiments, the fusion protein further comprises one or more linkers as described herein. In some embodiments, a fusion protein comprises, from N-terminus to C-terminus, a polypeptide with phase behavior, a linker, and a capture domain. In some embodiments, a fusion protein comprises, from N-terminus to C-terminus, a capture domain, a linker, and a polypeptide with phase behavior.

Environmental Factors

In some embodiments, one or more environmental factors are applied to cause a change of a complex comprising the protein-based purification matrix and biologic, contaminant, and/or other molecule. In some embodiments, the one or more environmental factors cause the size of a complex comprising the protein-based purification matrix and biologic, contaminant, and/or other molecule to increase. In some embodiments, the one or more environmental factors cause the polypeptide with phase behavior to aggregate. In some embodiments, the one or more environmental factors causes separation of the protein-based purification matrix from the biologic, contaminant, and/or small molecule. In some embodiments, the one or more environmental factors enables the biologic, contaminant, and/or other molecule to retain its native structure, function, and activity.

In some embodiments, the environmental factor is a change in temperature. In some embodiments, the temperature is increased about 0.5° C., about 1° C., about 2° C., about 3° C., about 4° C., about 5° C., about 6° C., about 7° C., about 8° C., about 9° C., about 10° C., about 11° C., about 12° C., about 13° C., about 14° C., about 15° C., about 16° C., about 17° C., about 18° C., about 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., about 37° C., about 38° C., about 39° C., or about 40° C. In some embodiments, the temperature is decreased about 0.5° C., about 1° C., about 2° C., about 3° C., about 4° C., about 5°

C., about 6° C., about 7° C., about 8° C., about 9° C., about 10° C., about 11° C., about 12° C., about 13° C., about 14° C., about 15° C., about 16° C., about 17° C., about 18° C., about 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., about 37° C., about 38° C., about 39° C., or about 40° C.

In some embodiments, the environmental factor is a change in pH. In some embodiments, the pH is increased by about 0.1, about 0.2, about 0.3, about 0.4, about 0.5, about 0.6, about 0.7, about 0.8, about 0.9, about 1.0, about 1.1, about 1.2, about 1.3, about 1.4, about 1.5, about 1.6, about 1.7, about 1.8, about 1.9, about 2.0, about 2.1, about 2.2, about 2.3, about 2.4, about 2.5, about 2.6, about 2.7, about 2.8, about 2.9, about 3.0, about 3.1, about 3.2, about 3.3, about 3.4, about 3.5, about 3.6, about 3.7, about 3.8, about 3.9, about 4.0, about 4.1, about 4.2, about 4.3, about 4.4, about 4.5, about 4.6, about 4.7, about 4.8, about 4.9, about 5.0, about 5.1, about 5.2, about 5.3, about 5.4, about 5.5, about 5.6, about 5.7, about 5.8, about 5.9, or about 6.0 units. In some embodiments, the pH is decreased by about 0.1, about 0.2, about 0.3, about 0.4, about 0.5, about 0.6, about 0.7, about 0.8, about 0.9, about 1.0, about 1.1, about 1.2, about 1.3, about 1.4, about 1.5, about 1.6, about 1.7, about 1.8, about 1.9, about 2.0, about 2.1, about 2.2, about 2.3, about 2.4, about 2.5, about 2.6, about 2.7, about 2.8, about 2.9, about 3.0, about 3.1, about 3.2, about 3.3, about 3.4, about 3.5, about 3.6, about 3.7, about 3.8, about 3.9, about 4.0, about 4.1, about 4.2, about 4.3, about 4.4, about 4.5, about 4.6, about 4.7, about 4.8, about 4.9, about 5.0, about 5.1, about 5.2, about 5.3, about 5.4, about 5.5, about 5.6, about 5.7, about 5.8, about 5.9, or about 6.0 units.

In some embodiments, the environmental factor is change in ionic strength. In some embodiments, the change in ionic strength is brought about by increasing the concentration of salt. In some embodiments, the change in ionic strength is brought about by decreasing the concentration of salt. Non-limiting examples of salts include sodium chloride, potassium chloride, ammonium chloride, sodium acetate, sodium citrate, copper sulfate, sodium iodide, ammonium sulfate, and sodium sulfate. In some embodiments, dialysis is used to change the concentration of salt in the composition containing the protein-based purification matrix and biologic, contaminant, and/or other molecule.

In some embodiments, the environmental factor is the addition of a cofactor. Non-limiting examples of cofactors include calcium, magnesium, cobalt, copper, zinc, iron, manganese, selenium, molybdenum, potassium, coenzyme A (CoA), a nucleoside triphosphate, and a vitamin. In some embodiments, the cofactor is calcium. In some embodiments, the nucleoside triphosphate is adenosine triphosphate, uridine triphosphate, guanosine triphosphate, cytidine triphosphate, or thymidine triphosphate. In some embodiments, the vitamin is a fat-soluble. In some embodiments, the vitamin is water-soluble. Non-limiting examples of vitamins include vitamin A, vitamin B1 (thiamine), vitamin B2 (riboflavin), vitamin B3 (niacin or niacinamide), vitamin B5 (pantothenic acid), Vitamin B6 (pyridoxine, pyridoxal, or pyridoxamine, or pyridoxine hydrochloride), vitamin B7 (biotin), vitamin B9 (folic acid), vitamin B12, vitamin C, vitamin D, Vitamin E, vitamin K, K1, and K2, folic acid, and biotin.

In some embodiments, the environmental factor is a change in the concentration of the protein-based purification matrix. In some embodiments, the environmental factor is a change in the concentration of the biologic, contaminant, and/or other molecule.

In some embodiments, the environmental factor is a change in pressure of the composition containing the protein-based purification matrix and biologic, contaminant, and/or other molecule. In some embodiments, a change in pressure can be effected by increasing or decreasing the volume of the composition.

In some embodiments, the environmental factor is the addition of one or more surfactants. In some embodiments, the one or more surfactants are selected from free fatty acid salts, soaps, fatty acid sulfonates, such as sodium lauryl sulfate, ethoxylated compounds, such as ethoxylated propylene glycol, lecithin, polygluconates, quaternary ammonium salts, lignin sulfonates, 3-((3-cholamidopropyl)dimethylammonio)-1-propanesulfonate (CHAPS), sugars, including sucrose and glucose, Triton X-100, and NP-40. In some embodiments, the surfactant is anionic, nonionic, or amphoteric.

In some embodiments, the environmental factor is the addition of one or more molecular crowding agents. Non-limiting examples of molecular crowding agents include polyethylene glycol, dextran, and ficoll. PEGS may include PEG400, PEG1450, PEG3000, PEG8000, and PEG10000.

In some embodiments, the environmental factor is the addition of one or more oxidizing agents. Non-limiting examples of oxidizing agents include hydrogen peroxide, hydrophilically or hydrophobically activated hydrogen peroxide, preformed peracids, monopersulfate or hypochlorite.

In some embodiments, the environmental factor is the addition of one or more reducing agents. In some embodiments, the one or more reducing agents is selected from the group consisting of dithiothreitol (DTT), 2-mercaptoethanol (BME), Tris (2-carboxyethyl) phosphine (TCEP), hydrazine, boron hydrides, amine boranes, lower alkyl substituted amine boranes, triethanolamine, and N,N,N',N'-tetramethylethylenediamine (TEMED).

In some embodiments, the environmental factor is the addition of one or more denaturing agents. Non-limiting examples of denaturing agents include urea, guanidine hydrochloride, guanidine, sodium salicylate, dimethyl sulfoxide, and propylene glycol.

In some embodiments, the environmental factor is the addition of one or more enzymes. Non-limiting examples of enzymes include proteases, kinases, phosphatases, synthetases, transferases, nucleases such as restriction endonucleases, lyases, isomerases, dehydrogenases, decarboxylases, and lipases.

In some embodiments, the environmental factor is the application of electromagnetic waves. In some embodiments, the environmental factor is the application of light. In some embodiments, the electromagnetic waves have a wavelength between about 0.0001 nm and about 100 m. In some embodiments, the electromagnetic waves are selected from the group consisting of gamma rays, x-rays, ultraviolet, visible, infrared, and radio waves. In some embodiments, the electromagnetic waves are gamma rays. In some embodiments, the gamma rays have a wavelength between about 0.0001 nm and about 0.01 nm, e.g. 0.0001 nm, 0.0005 nm, 0.001 nm, 0.002 nm, 0.003 nm, 0.004 nm, 0.005 nm, 0.006 nm, 0.007 nm, 0.008 nm, 0.009 nm, and 0.01 nm. In some embodiments, the x-rays have a wavelength between about 0.01 nm and about 10 nm, e.g. about 0.01 nm, 0.02 nm, 0.03 nm, 0.04 nm, 0.05 nm, 0.06 nm, 0.07 nm, 0.08 nm, 0.09 nm, 0.10 nm, 0.2 nm, 0.3 nm, 0.4 nm, 0.5 nm, 0.6 nm, 0.7 nm, 0.8 nm, 0.9 nm, 1 nm, 2 nm, 3 nm, 4 nm, 5 nm, 6 nm, 7 nm, 8 nm, 9 nm, or about 10 nm. In some embodiments, the ultraviolet radiation has a wavelength between about 10 nm about 400 nm, e.g. about 10 nm, about 20 nm, about 30 nm, about 40 nm, about 50 nm, about 60 nm, about 70 nm, about 80 nm, about 90 nm, about 100 nm, about 150 nm, about 200 nm, about 250 nm, about 280 nm, about 300 nm, about 350 nm, or about 400 nm. In some embodiments, the visible waves have a wavelength of between about 400 nm and about 800 nm, e.g. about 400 nm, about 450 nm, about 500 nm, about 550 nm, about 600 nm, about 650 nm, about 700 nm, about 750 nm, or about 800 nm. In some embodiments, the infrared radiation has a wavelength of between about 800 nm and about 0.1 cm, e.g. about 800 nm, about 1 μm, about 2 μm, about 3 μm, about 4 μm, about 5 μm, about 6 μm, about 7 μm, about 8 μm, about 9 μm, about 10 μm, about 20 μm, about 30 μm, about 40 μm, about 50 μm, about 60 μm, about 70 μm, about 80 μm, about 90 μm, about 100 μm, about 200 μm, about 300 μm, about 400 μm, about 500 μm, about 600 μm, about 700 μm, about 800 μm, about 900 μm, or about 0.1 cm. In some embodiments, the radio waves has a wavelength of between about 0.1 cm and 100 m, e.g. about 0.1 cm, about 1 cm, about 10 cm, about 100 cm, about 1000 cm, about 2000 cm, about 3000 cm, about 4000 cm, about 5000 cm, about 6000 cm, about 7000 cm, about 8000 cm, about 9000 cm, or about 100 m.

In some embodiments, the environmental factor is the application of acoustic waves. In some embodiments, the acoustic waves have a frequency between about 1 Hz and 2000 kHz. In some embodiments, the acoustic waves have a frequency of about 1 Hz, about 5 Hz, about 10 Hz, about 20 Hz, about 30 Hz, about 40 Hz, about 50 Hz, about 60 Hz, about 70 Hz, about 80 Hz, about 90 Hz, about 100 Hz, about 200 Hz, about 300 Hz, about 400 Hz, about 500 Hz, about 600 Hz, about 700 Hz, about 800 Hz, about 900 Hz, about 1 kHz, about 100 kHz, about 200 kHz, about 300 kHz, about 400 kHz, about 500 kHz, about 600 kHz, about 700 kHz, about 800 kHz, about 900 kHz, about 1000 kHz, about 1100 kHz, about 1200 kHz, about 1300 kHz, about 1400 kHz, about 1500 kHz, about 1600 kHz, about 1700 kHz, about 1800 kHz, about 1900 kHz, or about 2000 kHz.

EXAMPLES

Example 1. Development of Protein-Based Purification Matrices that Exhibit Phase Behavior and Bind to a Biologic A protein-based purification matrix is generated and characterized. Initially, an expression vector comprising a sequence encoding a capture domain that binds to the Fc region of an antibody and a sequence encoding a polypeptide with phase behavior (e.g., an ELP) is generated. A fusion protein comprising the capture domain and polypeptide with phase behavior is expressed in *Escherichia coli* according to standard protocols. Isothermal titration calorimetry is utilized to characterized the affinity of the fusion protein for pure human immunoglobulin G (IgG). The transition temperature of the fusion protein is determined using UV-Vis spectrophotometry.

Example 2. Utilization of Protein-Based Purification Matrices that Exhibit Phase Behavior and Bind to a Biologic to Purify Protein The protein-based purification matrix of Example 1 is utilized to purify an antibody such as trastuzumab (Herceptin®). Various molar ratios of protein-based purification matrix to biologic (e.g. trastuzumab) are tested to determine an optimal ratio for purification (i.e., for complete capture of the biologic). An environmental factor (e.g., addition of salt such as sodium chloride or ammonium sulfate) is applied to the composition containing the protein-based purification matrix and the biologic to cause the protein-based purification matrix increase in size.

Both tangential flow filtration and centrifugation are utilized to separate the biologic from the protein-based purification matrix. Although both centrifugation and tangential flow filtration enable separation of the biologic from the protein-based purification matrix, tangential flow filtration is preferred because it enables the rapid purification of thousands of liters of sample volume without the requirement for specialized centrifuges.

TFF is performed using standard conditions—for example, a 1.5 bar transmembrane pressure and a 960 L/m²/h cross flow rate. Standard TFF membranes are used, such as a 0.1 μm hydrophilized poly(vinylidene difluoride) (PVDF) or a 0.2 μm polyethersulfone membrane.

The pH is adjusted (for example to an acidic pH such as 2-4.5, or pH 3) to separate (i.e. elute) the protein-based purification matrix from the biologic. The purity of the biologic is characterized by size exclusion chromatography. The protein-based purification matrix is then re-used for an additional round of purification.

Example 3. Utilization of Protein-Based Purification Matrices that Exhibit Phase Behavior and Bind to a Biologic to Purify Cell A protein-based purification matrix is utilized to purify T cells. The capture domain of the protein-based purification matrix specifically binds to T cells, for example, by recognizing a T-cell specific surface marker such as CD3, CD4, or CD8. Various molar ratios of protein-based purification matrix to T cell are tested to determine an optimal ratio for purification. Various environmental factors are tested, such as different salts and salt concentrations, to determine the most efficacious way of isolating T cells.

Tangential flow filtration and/or centrifugation and/or continuous centrifugation are utilized to separate the T cell from the protein-based purification matrix.

Example 4. Purification of AAV9 Using a Purification Matrix and Tangential Flow Filtration (TFF)

HEK293 cells producing a recombinant AAV9 vector packaging a tdTomato transgene were grown in suspension and harvested by centrifugation. 200 mL of the supernatant were treated with 10 U/mL benzonase and 0.01% pluronic acid and sterile filtered through a 0.2-micron bottle-top filter. This starting material (SM) was then mixed with 1 μM purification matrix having an amino acid sequence of SEQ ID NO: 172 and 0.6 M NaCl salt (i.e., the first environmental factor) to form an AAV-purification matrix complex.

Figure 1:
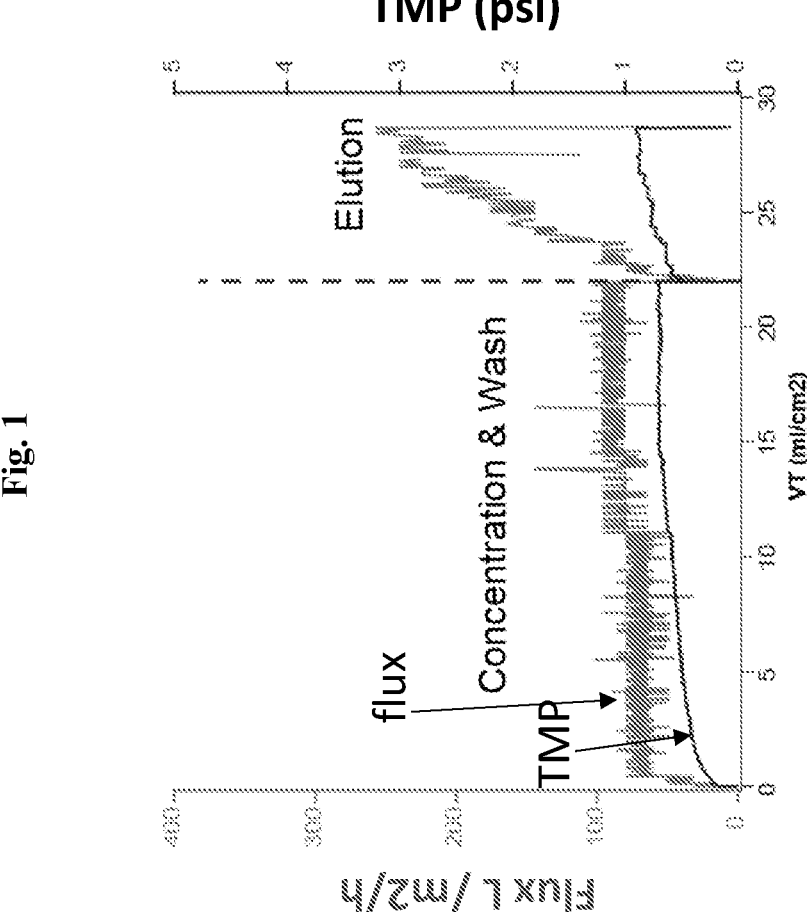
FIG. 1 is a graph that shows the tangential flow filtration flux and transmembrane pressure during the separation of an AAV9-purification matrix complex from impurities. The purification matrix can efficiently purify AAV9 particles with tangential flow filtration (TFF) in oncentration-diafiltration-concentration-diafiltration (CDCD) mode. The process is performed at high flux and with a low and stable transmembrane pressure (TMP) in permeate-control mode.
Figure 2:
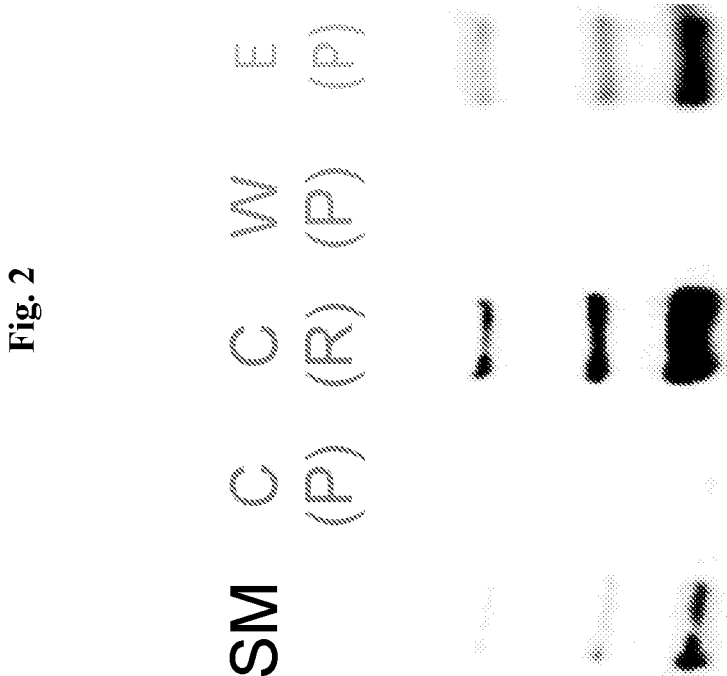
FIG. 2 is a western blot, which shows the presence or absence of VPI, VP2, and VP3 proteins of AAV, at different steps of the tangential flow filtration (TFF) process. The first lane, labeled SM (starting material) shows the presence of AAV particles in the starting material. The SM is supernatant from cultured HEK293 cells producing a recombinant AAV9 vector packaging a tdTomato transgene that is treated with 10 U/mL benzonase and 0.01% pluronic acid. The second lane, labeled C (P), shows the absence of AAV particles in the permeate. The third lane, labeled C (R), shows the presence of AAV particles in the retentate. The fourth lane, labeled W(P), shows the absence of AAV particles in the wash containing removed contaminants. The fifth lane, labeled E(P), shows the eluted AAV particles.
Figure 3:
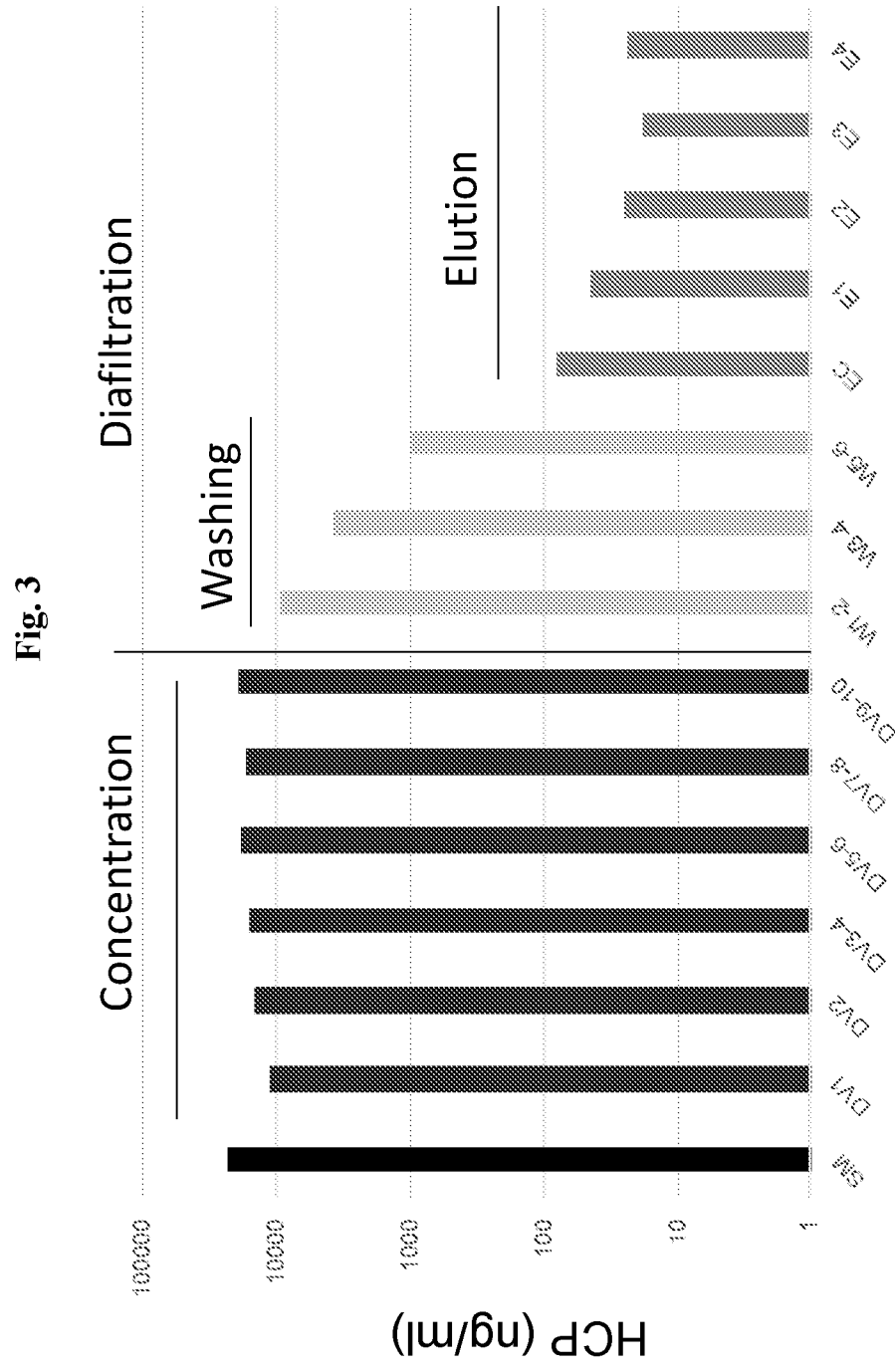
FIG. 3 is a graph showing quantitation of contaminant host cell proteins (HCP) within a composition containing an AAV-purification matrix complex during TFF concentration and diafiltration. The composition containing the AAV-purification matrix complex is referred to as SM or "starting material" and contains AAV9 particles. Throughout the concentration and diafiltration stages of TFF, 1 mL fractions are collected. DV1, DV2, DV3-4, DV5-6, DV7-8, and DV9-10 refer to fractions collected during the concentration stage of TFF. W1-2, W3-4, and W5-6 refer to fractions collected during the washing stage of diafiltration. EC, E1, E2, E3, and E4 refer to fractions collected during the elution stage of diafiltration.
Figure 4:
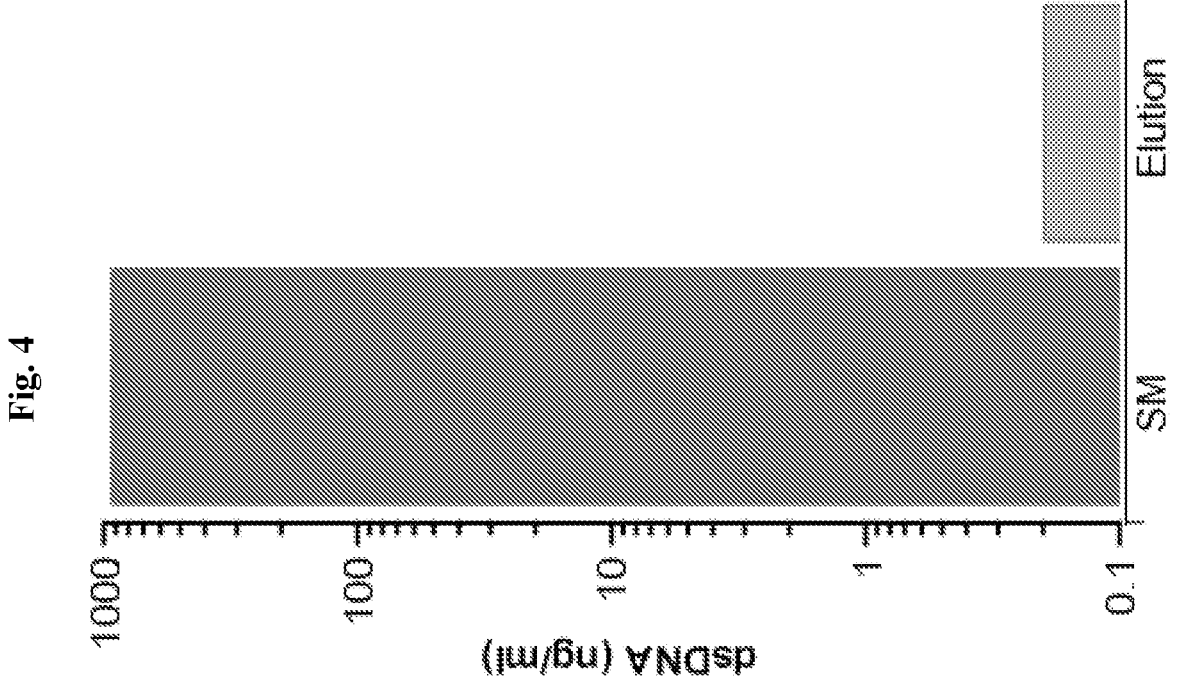
FIG. 4 is a graph showing the concentration of double stranded DNA (dsDNA) impurities in a composition comprising AAV9 particles before purification with a purification matrix (referred to as starting material (SM)) and after purification with a purification matrix (referred to as "elution").

This SM was processed in continuous fed-batch mode using a Repligen KR2i tangential-flow filtration (TFF) unit. The TFF was setup with a 20 mL retentate vessel, prepared with 50 μM purification matrix and 0.6 M NaCl, as well as a 13 cm² hollow fiber filter with 0.2-micron pores. A concentration-diafilter (CD) mode (10× concentration factor (CF), 6× diavolumes (DV)) was run in permeate control with the SM and permeate pump set to equal flow rates. Once the entire 200 mL SM feed was processed, the retained material was rinsed with 6 DV of wash buffer (20 mM Tris, 0.5M NaCl). The AAV9 material, now substantially free of contaminants, was then resolubilized on ice and mixed with an equal volume of 2× Elution buffer (i.e., a second environmental factor) with the permeate valve closed. The elution buffer contained 100 mM glycine at pH 3 and 0.6 M NaCl. After 20 minutes, the recirculating sample was warmed back to room temperature and phase separated with NaCl. The permeate valve was opened and pure AAV9 was collected in a second CD mode (2× CF, 4× DV) with elution buffer diavolumes (100 mM glycine, pH 3, 0.6M NaCl). The flux and transmembrane pressure (TMP) were tracked throughout the run (FIG. 1), demonstrating a stable, efficient, and scalable process. Permeate and retentate samples were collected throughout the run for analysis of AAV loss by anti-AAV Western Blot (FIG. 2), as well as purity by host cell protein (HCP) quantification using a HEK HCP ELISA (CygnusR) and dsDNA quantification using a Quant-iT™ picogreen assayR (Thermo FisherR). The process enabled removal of HCPs by 2-3 log (FIG. 3) and of double stranded DNA (dsDNA) by >3 log (FIG. 4).

Example 5. Effect of Titer, Clarification, and Nuclease Treatment on AAV Purification The ability of purification matrix having an amino acid sequence of SEQ ID NO: 172 to capture AAV8 particles from cell lysate or the media of suspension cultures of HEK293 cells producing AAV8 particles (referred to in FIG. 10 as "supernatant") was tested.

A cell lysate was produced by resuspending pelleted HEK293 cells producing AAV8 particles in 0.5% Triton-X-100. The cell lysate and media evaluated contained titers of AAV particles that ranged from $1 \times 10^8$ to $1 \times 10^7$ viral particles per microliter (vp/μL). The ability of purification matrix to capture AAV8 particles from cell lysate treated with nuclease was also evaluated. Cell lysates that were treated with nuclease were incubated for 1 hr at 34° C. with 50 U/mL benzonase (Millipore®).

The ability of purification matrix to capture AAV8 particles from clarified cell lysate or media was also evaluated. Cell lysates and/or media were clarified by centrifugation at 13,200 rpm for 10 minutes. The supernatant was used for subsequent isolation of the AAV8 particles for 10 min at 13,200 rpm.

AAV8 particles were isolated from each sample by mixing the sample with 10 μM purification matrix and 0.6 M NaCl (i.e., a first environmental factor) and centrifuging the sample at 13,200 rpm for 10 minutes.

The pellets containing AAV-purification matrix complex were resuspended on ice in an elution buffer (i.e., second environmental factor) comprising 100 mM glycine at pH 3, warmed to room temperature, transitioned with 0.6 M salt, and then centrifuged a second time. The amount of eluted AAV8 was compared to that in the starting material, (i.e the media or cell lysate comprising AAV8 particles) using inverted terminal repeat (ITR) quantitative polymerase chain reaction (qPCR). This technique quantitates the number of AAV particles by measuring the number of ITRs using PCR. The AAV Capture Efficiency for each sample was calculated using the following equation: 100×(#of AAV8 particles captured by the purification matrix/#of AAV8 particles in the composition before purification).

Figure 5:
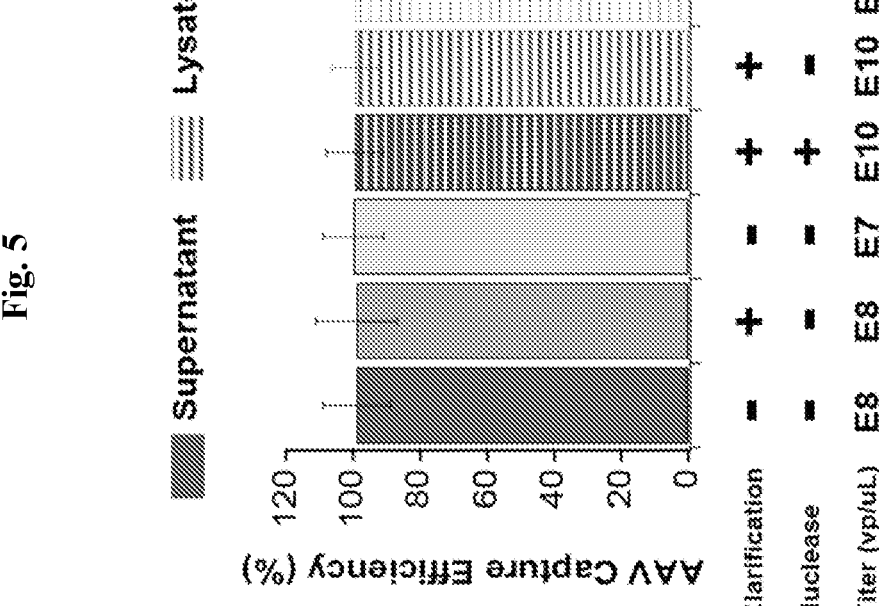
FIG. 5 is a graph that shows a purification matrix's efficiency in capturing AAV particles (AAV Capture Efficiency) after clarification and/or treatment with nuclease. The compositions comprising AAV8 particles included compositions from the cell lysate of HEK293 cells producing AAV8 particles, referred to as "lysate," and compositions comprising media harvested from HEK293 cells producing AAV8 particles, referred to as "supernatant". The compositions contained viral titers of $1\times10^7$ viral particles per microliter (vp/uL) (referred to as "E7"), $1\times10^8$ vp/uL ("E8"), or $1\times10^{10}$ vp/uL ("E10"). The compositions were clarified (+) or not clarified (−). The compositions were exposed to nuclease (+) or not exposed to nuclease (−). A purification matrix was used to capture AAV8 particles from each composition. The AAV Capture Efficiency for each sample was calculated using the following equation: 100×(#of AAV8 particles captured by the purification matrix/#of AAV8 particles in the composition before purification).
Figure 6:
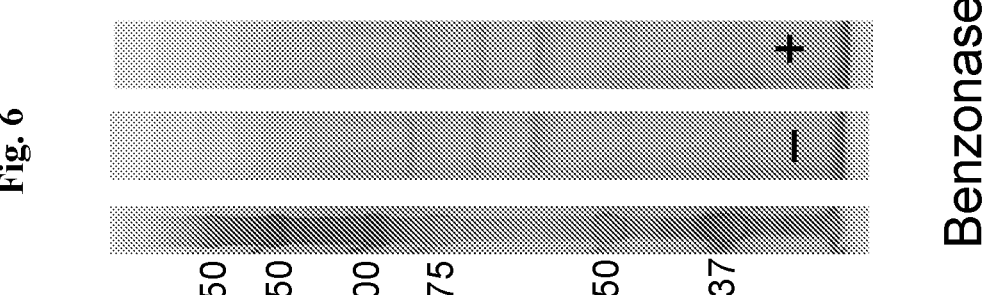
FIG. 6 provides an image of a silver stained SDS-PAGE gel, which shows that purification of AAV8 particles with purification matrix yields highly pure AAV8 particles, regardless of pre-treatment with benzonase nuclease. (−) indicates no pre-treatment with benzonase nuclease was performed, and (+) indicates that pre-treatment was performed. The first lane shows molecular weight markers (kDa).
Figure 7:
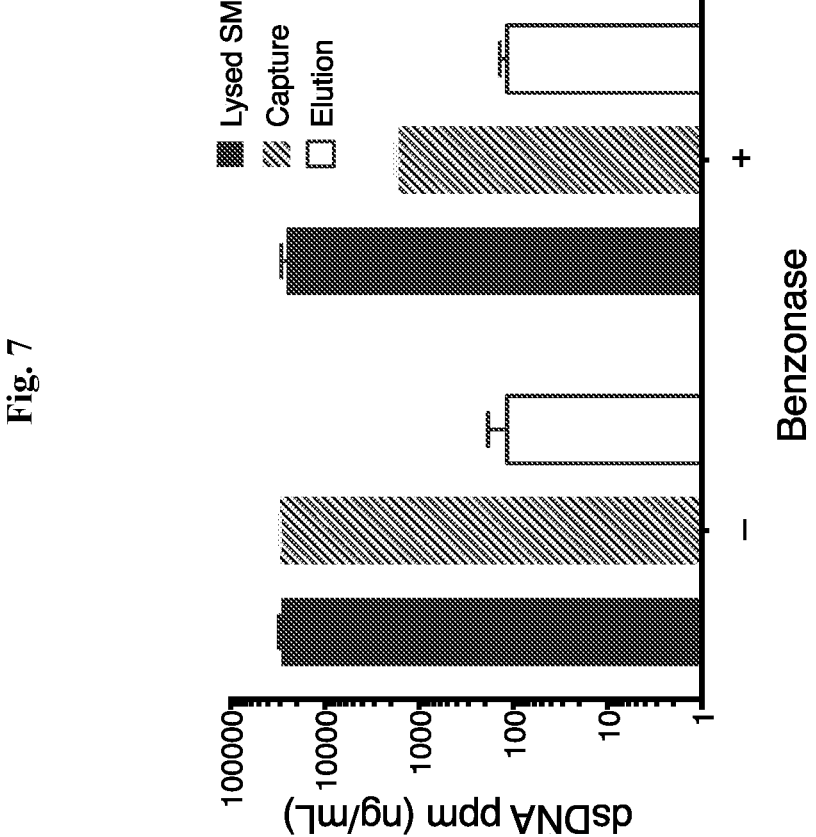
FIG. 7 is a graph that shows dsDNA concentration in AAV8 samples with (+) or without (−) benzonase nuclease pre-treatment. With or without pre-treatment, the compositions comprising purified AAV8 eluted from the purification matrix had similar levels of dsDNA, as assessed by Quant-iT picogreen assay. Lysed SM: starting material comprised of clarified cell lysate; Capture: purification matrix capture step supernatant; Elution: purification matrix elution step supernatant.

The purification matrix robustly captured >98% AAV particles regardless of titer ($1 \times 10^7$ to $4 \times 10^{10}$), clarification, nuclease treatment, or lysate versus media as the starting material (FIG. 5). Evaluation of lysate samples with and without nuclease treatment showed that nuclease treatment did not impact final eluted AAV8 particle purity when compared by silver stain SDS-PAGE (FIG. 6) and Quant-iT™ picogreen assay for dsDNA (FIG. 7).

Example 6. Effect of Centrifugation Speed on AAV8 Capture

Figure 8:
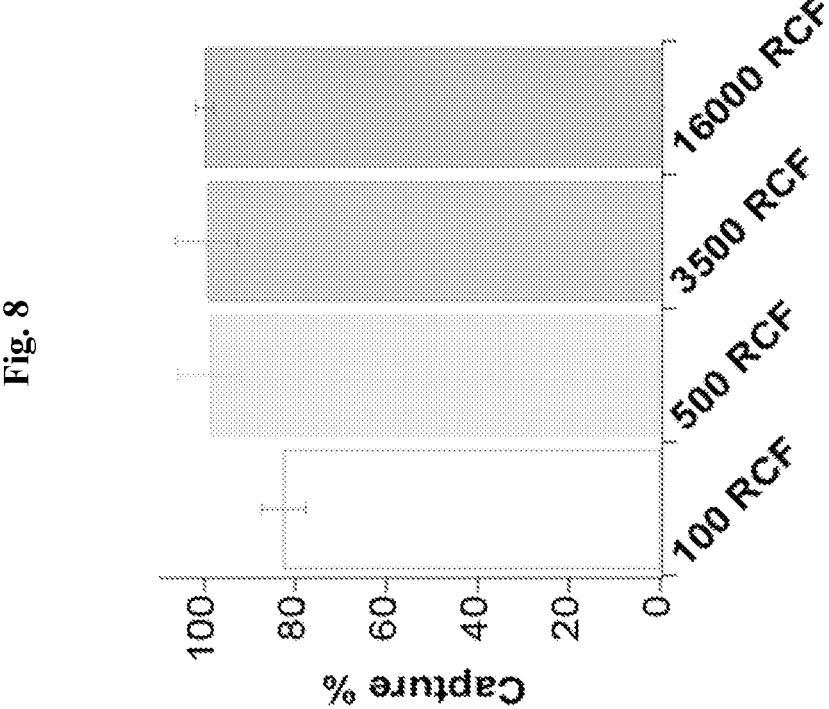
FIG. 8 shows AAV Capture Efficiency after centrifugation at various speeds. The figure shows that >95% capture of AAV8 particles is achieved using centrifugation speeds at or greater than 500 relative centrifugal force (RCF), including 3500 and 16000 RCF.

Harvested media from AAV8 HEK293 suspension cell culture was mixed with 10 µM of Purification Matrix having an amino acid sequence of SEQ ID NO: 172 and 0.6 M NaCl to form an AAV-purification matrix complex. The samples were centrifuged for 10 min at relative centrifugal forces (RCF) ranging from 100 to 16,000. For each RCF, uncaptured AAV8 remaining in the supernatant was quantified using ITR qPCR and calculated as a percentage of the amount measured in the starting harvest material. The AAV Capture Efficiency was measured as 100% less the percentage remaining uncaptured in the supernatant and results showed that speeds of 500 RCF or higher yielded highly efficient AAV8 capture (FIG. 8).

Example 7. Stabilization of AAV2 by Purification Matrix

Figure 9:
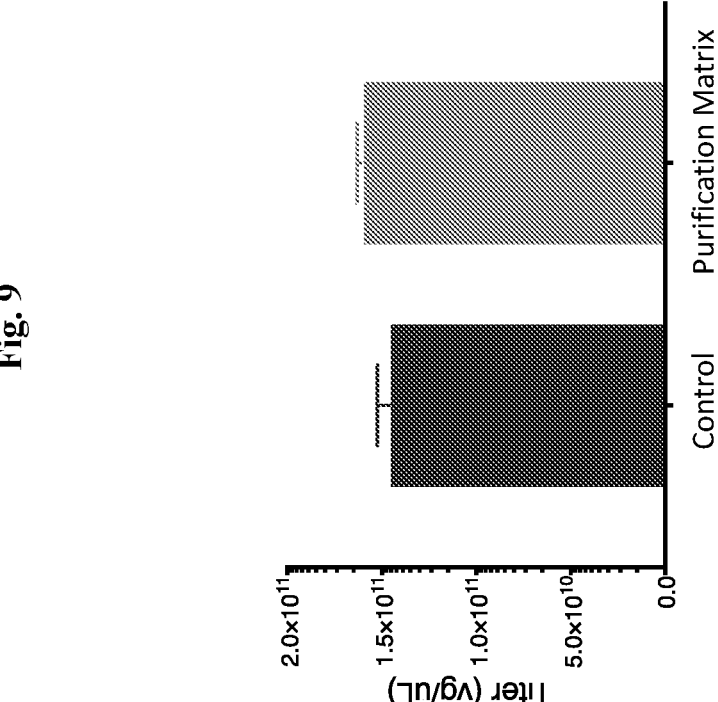
FIG. 9 shows a comparison of the AAV2 titers produced by HEK293 cell cultures under standard conditions (control) or with the addition of purification matrix as quantified by inverted terminal repeat (ITR) quantitative polymerase chain reaction (qPCR) The data shows that the presence of purification matrix may increase titers by 8% or more. Student's t-test, p=0.077.

Adherent HEK293 cells were transfected according to a standard triple transfection method, and used to produce recombinant AAV2 particles carrying a luciferase transgene. The cells were cultured for 6 days, in the presence or absence of purification matrix having an amino acid sequence of SEQ ID NO: 172. Cells cultured in the presence of 10 µM purification matrix were compared to control cells, with each group, treatment or control, in triplicate. The culture media was collected on day 4 and replaced with an equal volume of media with or without the purification matrix additive. On day 6, the media was collected again and the cells were rinsed with PBS and harvested by scraping. The total vector genomes collected in all fractions were quantified for comparison using qPCR using primers against ITR2. Inclusion of the purification matrix in the culture media increased vector genome (vg) titers by at least 8% (FIG. 9).

Example 8. Stabilization of AAV8 by Purification Matrix

Figure 10:
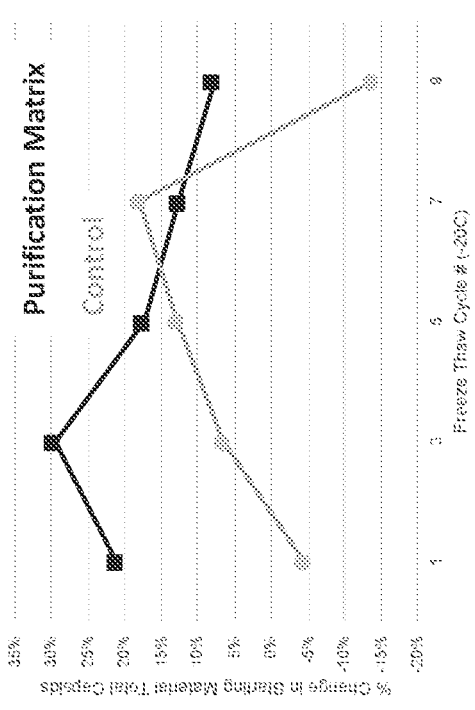
FIG. 10 shows the percent change of total AAV8 capsids after repeated freeze-thaw cycles in a composition comprising AAV8 particles and purification matrix and a composition comprising AAV8 particles and PBS (negative control).

Media was harvested from HEK293 cells grown in suspension, wherein the cells were producing GFP-AAV8. The media was aliquoted and stored at −20° C. either with or without the addition of 100 µM of purification matrix having an amino acid sequence of SEQ ID NO: 172. As an accelerated stability study, the samples were subjected to freeze-thaw cycles (−20° C. to room temperature) and then assayed using an AAV8 ELISA (Progen), which quantifies total intact AAV particles. The quantified particles for the control and purification matrix-treated samples were normalized to the starting materials with no freeze-thaws. This data indicates that the purification matrix may enhance the resistance of AAV particles to freeze-thaw-mediated degradation and aggregation (FIG. 10).

Example 9. Capture of AAV8 Particles with a Purification Matrix

Figure 11:
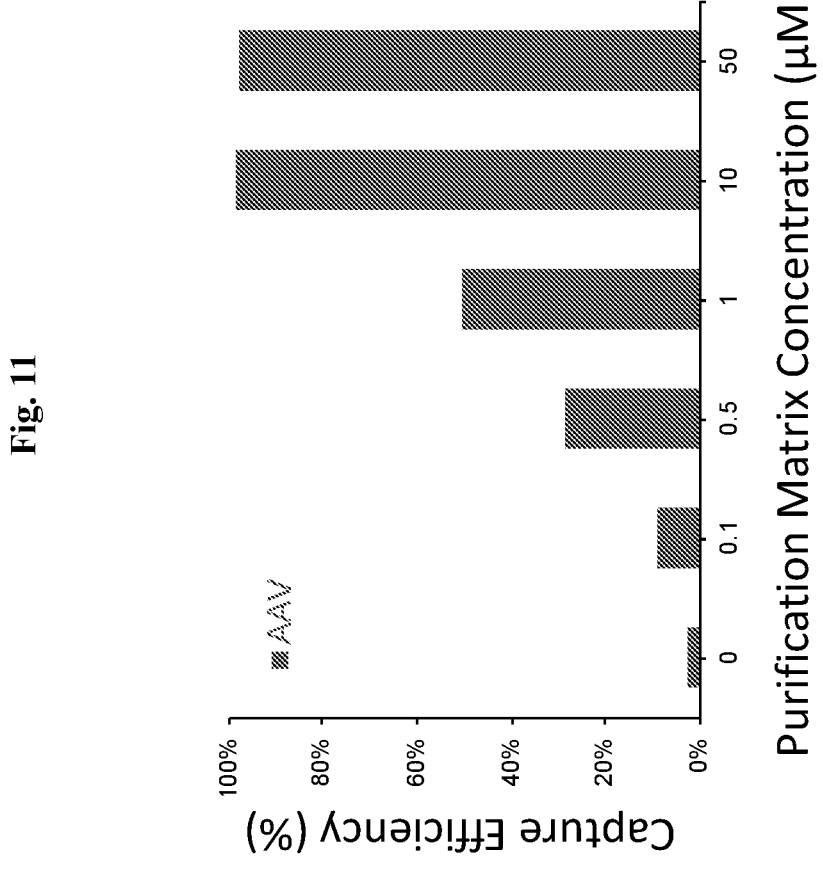

Media was harvested from HEK293 suspension cells producing AAV8 particles carrying a luciferase (luc) transgene. The media was contacted with 0 µM, 0.1 µM, 0.5 µM, 1 µM, 10 µM, and 50 µM purification matrix having an amino acid sequence of SEQ ID NO: 172, resulting in the formation of complexes between AAV8 particles and purification matrix. A first environmental factor (i.e. 0.6 M NaCl) was applied to increase the size of the complexes. Subsequently, the media containing the complexes was centrifuged at 13,200 revolutions per minute (rpm) for 10 minutes (min). This protocol allowed for separation of the complexes from impurities on the basis of size. Inverted terminal repeat (ITR) quantitative polymerase chain reaction (qPCR) was utilized to evaluate the amount of AAV particles captured from the media using the purification matrix compared to the amount of AAV particles in the starting material. This technique quantitates the number of AAV particles by measuring the number of ITRs using PCR. The Capture Efficiency of the purification matrix at each concentration was calculated using the following equation: 100×(#of AAV8 particles captured by the purification matrix/#of AAV8 particles in the composition before purification). FIG. 11 shows that purification matrix concentrations at or above 10 µM are sufficient for robust, >98%, virus capture.

Example 10. Capture of Ad5 Particles with a Purification Matrix

Media was harvested from HEK293 cells grown in suspension, wherein the cells were producing adenovirus type 5 (Ad5) particles carrying a green fluorescent protein (GFP) transgene. The media was contacted with 0 µM, 0.1 µM, 0.5 µM, 1 µM, 10 µM, and 50 µM purification matrix having an amino acid sequence of SEQ ID NO: 173, resulting in the formation of complexes between Ad5 particles and purification matrix. A first environmental factor (i.e. 0.6 M NaCl) was applied to increase the size of the complexes. Subsequently, the media containing the complexes was centrifuged at 13,200 revolutions per minute (rpm) for 10 minutes (min). This protocol allowed for separation of the complexes from impurities on the basis of size.

Flow cytometry was utilized to evaluate the amount of Ad5 particles captured from the media using the purification matrix compared to the amount of Ad5 particles in the starting material. The Capture Efficiency of the purification matrix at each concentration was calculated using the following equation: 100×(#of Ad5 particles captured by the purification matrix/#of Ad5 particles in the composition before purification). FIG. 12 shows that purification matrix concentrations at or above 10 µM are sufficient for robust, >98%, virus capture.

Example 11. Capture of Lentivirus Particles with a Purification Matrix

Lentivirus particles carrying a green fluorescent protein (GFP) transgene were mixed with 10 µM of purification matrix or PBS (negative control). Mixture of lentivirus particles with purification matrix having an amino acid sequence of SEQ ID NO: 174 leads to the formation of complexes between lentivirus particles and purification matrix. A first environmental factor (i.e. 0.5 M NaCl) was applied to increase the size of the complexes. The composition containing lentivirus particles and purification matrices, and the composition containing lentivirus particles and PBS were centrifuged at 13,200 revolutions per minute (rpm) for 10 minutes (min). The supernatants of each composition, which contained uncaptured lentivirus particles, were added to the media of adherent HEK293 cells for 48 hours. Subsequently, the cells were fluorescently imaged. HEK293 cells incubated with supernatant from the composition comprising lentivirus particles and PBS exhibited greater fluorescence than HEK293 cells incubated with supernatant from the composition comprising lentivirus particles and purification matrix.

Thus, more lentivirus particles were contained in the supernatant of the composition containing lentivirus particles and PBS than the composition containing lentivirus particles and purification matrix. This shows that the purification matrix captured lentivirus particles (FIG. 13).

This experiment is repeated with a purification matrix having an amino acid sequence of SEQ ID NO: 175.

Example 12. Capture of Human Serum Albumin (HSA) with a Purification Matrix

Human serum albumin (HSA) was contacted with a purification matrix having an amino acid sequence of SEQ ID NO: 176 for a period of time to allow complex formation. A first environmental factor was applied to the complexes (i.e. about 0.6 M NaCl) to increase the size of the complexes.

The composition comprising the HAS, purification matrix, and 0.5 M NaCl was applied to two filters, a filter with a 0.2 μm pore size and a filter with a 300 kilodalton (kDa) molecular weight cutoff. The filtrate was applied to a sodium dodecyl sulfate polyacrylamide gel electrophoresis (SDS-PAGE) gel, which was subsequently stained with a Coomassie dye.

The SDS-PAGE gel shows the presence of a band for HSA (at 66.5 kDa) in the filtrate from the 0.2 μm pore size filter and the absence of the band for HSA in the filtrate from the 300 kDa filter. The 300 kDa filter retained >90% of the HSA. Thus, capturing HSA with a purification matrix, and increasing the size of the complexes with an environmental factor increases the size of HSA such that 90% of the HSA is retained by the filter (FIG. 14).

Example 13. Infectivity of Ad5 Particles in the Presence of Purification Matrix Media was harvested from HEK293 cells producing adenovirus type 5 (Ad5) particles carrying a green fluorescent protein (GFP) transgene. The media containing Ad5 particles was incubated at room temperature (about 25° C.) or 35° C. with purification matrix having an amino acid sequence of SEQ ID NO: 173, purification matrix control (having no specificity for Ad5), or PBS.

At days 0, 3, 7, and 11, post incubation, the media was harvested and administered to HEK293 cells. Flow cytometry was performed to evaluate the ability of the Ad5 particles to infect HEK293 cells, as indicated by the percentage of green fluorescing cells (labeled infectivity in FIG. 15). The infectivity for each source of Ad5 particles was normalized to that source's day 0 infectivity. The infectivity of Ad5 particles obtained from media incubated with purification matrix (labeled Purification Matrix) was higher than the infectivity of Ad5 particles obtained from media incubated with purification matrix control (labeled Matrix Control), and media incubated with PBS (labeled PBS control) after 3, 7, and 11 days (FIG. 15). Media incubated in the presence of purification matrix was more infective than media incubated in the presence of PBS (labeled control) at both room temperature and 35° C. (FIG. 16).

Example 14. Stabilization of Ad5 to Freeze-Thaw Cycles

Purified adenovirus type 5 (Ad5) particles carrying a green fluorescent protein (GFP) transgene were formulated in PBS with or without the addition of 10 μM purification matrix or Matrix control (no specificity for Ad5). The samples were subjected to three freeze-thaw cycles (-80° C. to room temperature). Using flow cytometry, the ability of each composition of Ad5 particles to infect HEK293 cells was quantified by counting the percentage of green fluorescing cells and normalizing the percentage of green fluorescing cells resulting from each composition to a control composition comprising Ad5 particles in the absence of purification matrix that were subjected to freeze-thaw cycles. Ad5 particles incubated with Purification Matrix had 20-40% higher infectivity compared to the Ad5-GFP particles incubated with a Matrix Control or PBS (labeled PBS control). (FIG. 17).

Example 15. Separation of Biologic from Contaminant Using Two Purification Matrices A purification matrix with a lower critical solution temperature transition temperature ($T_t$) is labeled with a blue fluorescent dye and a purification matrix with an upper critical solution temperature (UCST) $T_t$ is labeled with a red fluorescent dye. An environmental factor (e.g. NaCl) is added to the composition comprising both purification matrices to promote the formation of insoluble droplets of both purification matrices. Fluorescence imaging is performed to evaluate if each droplet contains a single purification matrix or both purification matrices.

The ability to form droplets containing a single purification matrix allows for separation of droplets of each purification matrix.

A first purification matrix that binds to a biologic and a second purification matrix that binds to a contaminant is added to a composition containing a biologic and a contaminant. A first complex between the biologic and first purification matrix forms. A second complex between the contaminant and second purification matrix forms. An environmental factor is added to separate the first complex from the second complex.

Example 16. Purification of Recombinant IgG1 Using Purification Matrices and Tangential Flow Filtration (TFF)

Starting material (SM) containing ~4.8 g/L recombinant immunoglobulin 1 (IgG1) secreted from CHO cells was contacted with about 100 μM of purification matrix. The capture domain of the purification matrix binds to the Fc region of IgG1, resulting in a complex between purification matrix and IgG1. An environmental factor (0.6 M NaCl) was added to increase the size of the complexes.

TFF was used to concentrate the complexes and to separate the complexes from impurities. The composition comprising the complexes was applied to a 13 cm² polyethersulfone (PES) membrane which contained 0.2 μm pores. The composition was concentrated 2× and washed with a phosphate-buffered saline (PBS) wash buffer containing 0.6 M NaCl to remove impurities from the complexes. An elution buffer (7 diavolumes) was applied to the filter (50 mM sodium citrate, pH 3, 0.6M NaCl) to separate the IgG from the purification matrix. trigger release of the captured, concentrated and purified IgG1. The purity of the IgG was assessed by an SDS-PAGE gel, stained with a Coomassie dye (FIG. 18). The SDS-PAGE gel shows the high purity and recovery of the eluted IgG1.

High flux and transmembrane pressure (TMP) were maintained throughout the run (FIG. 19), indicating that the use of TFF enables a reduction in the time required to concentrate and separate a biologic from an impurity.

Size exclusion chromatography was performed to evaluate the purity of the eluted IgG1 product. The IgG1 product was applied to a TSKgel 3000sWXL column, and a mobile phase (i.e. 50 mM phosphate, 100 mM NaCl, at pH 7) was applied to the column at a 0.4 mL/min flow rate. The pure IgG1 was detected by measuring the absorbance at 230 nm. In comparison to the unpurified IgG1 composition, the pure IgG1 was >98% pure. Furthermore, the IgG1 product contained <1.5% of aggregated IgG1 (FIG. 20).

The purification process described above was repeated with antibodies of different subclasses (IgG2, IgG4, IgG1). The purity of antibodies purified from the aforementioned method was compared to antibodies purified by protein A chromatography (FIG. 21). Antibodies purified with a purification matrix exhibited less contaminant host cell proteins (HCP) than antibodies purified by protein A chromatogra- Ultraviolet-visible spectrophotometry (UV-Vis) and size exclusion chromatography (SEC) were utilized to determine the yield of IgG1, IgG2, and IgG4 produced according to purification method (a) or purification method (b). Size exclusion chromatography was used to determine the amount of high molecular weight (HMW) and low molecular weight (LMW) impurities in each sample. Purification method (a) resulted in purified immunoglobulin that is more concentrated than that produced by purification method (b). Table 3 shows the yield and percentage of HMW and LMW impurities present in the purified immunoglobulin compositions of purification method (a) and purification (b). The size exclusion chromatography area under the curve (SEC AUC) concentration and yield were obtained by normalizing the area under the curve (AUC) from SEC obtained from method (a) to that of method (2). Molecule-optimized downstream process values are shown in parentheses.

| | Cell culture harvest (CCH)titer (g/L) | Concentration (g/L) as determined by UV-Vis | Plate Yield as determined by UV-Vis (%) | SEC AUC Concentration (Normalized) | SEC AUC Yield (Normalized) | SEC Chromatogram AUC Analysis | | |
| --- | --- | --- | --- | --- | --- | --- | --- | --- |
| | | | | | | Peak Containing HMW (%) | Peak containing antibody (%) | Peak Containing LMW (%) |
| IgG 2 | | | | | | (2.8) | (99.6) | (0.0) |
| Method (b) | 3.17 | 1.20 | 22.7 | 1.00 | 1.00 | 1.79 | 97.99 | 0.22 |
| Method (a) | | 4.71 | 74.0 | 3.65 | 3.23 | 3.17 | 96.57 | 0.14 |
| IgG1 | | | | | | (2.7) | (97.3) | (0.0) |
| Method (b) | 0.87 | 0.39 | 26.9 | 1.00 | 1.00 | 1.55 | 98.45 | 0.00 |
| Method (a) | | 1.32 | 75.6 | 3.50 | 2.30 | 2.54 | 97.25 | 0.21 |
| IgG4 | | | | | | (0.8) | (99.2) | (0.0) |
| Method (b) | 0.70 | 0.39 | 33.4 | 1.00 | 1.00 | 0.47 | 99.53 | 0.00 |
| Method (a) | | 1.39 | 98.9 | 2.33 | 3.63 | 1.07 | 98.82 | 0.11 | phy. Host cell proteins were quantified with a Cygnus™ CHO host cell protein (HCP) ELISA detection kit.

The purification matrices also provided higher productivity than the protein A resins used in protein A affinity chromatography (FIG. 22). Productivity was calculated as grams of antibody per unit of material (resin or purification matrix) per hour.

Example 17. Purification of IgG1, IgG2, and IgG4 Using a Purification Matrix The effect of purification matrix on yield and purity of IgG1, IgG2, and IgG4 was evaluated. The following purification methods (a) and (b) were evaluated:

Purification method (a): IgG1, IgG2, or IgG4 from the supernatants of CHO cells containing secreted IgG1, IgG2, or IgG4 was purified by incubating the supernatant with the purification matrix of Example 16 to form complexes, increasing the size of the complexes by the addition of a first environmental factor (i.e., 0.6 M NaCl), separating the complexes from impurities using centrifugation, and eluting the IgG1, IgG2, or IgG4 from the purification matrix with a second environmental factor (i.e., 50 mM sodium citrate, pH 4).

Purification method (b): IgG1, IgG2, or IgG4 from the supernatants of CHO cells containing secreted IgG1, IgG2, or IgG4 was purified by incubating the supernatant with MAbSelect™ SuRe affinity chromatography resin (an alkali-stabilized protein A-derived ligand), washing with 140 mM NaCl, 10 mM phosphate buffer, and 3 mM KCl, pH 7.4, and eluting with 50 mM citrate buffer at pH 3.

Example 18. Purification of Multiple AAV Serotypes Using a Purification Matrix Recombinant AAV particles, including AAV1, AAV2, AAV6, AAV8, and AAV9 particles, packaging a tdTomato transgene, were produced in a producer cell line (e.g., HEK293) according to standard protocols. The cells were lysed, and centrifuged to remove cellular debris. The cellular supernatant was contacted with a purification matrix having an amino acid sequence of SEQ ID NO: 172 for a period of time to allow complex formation. An environmental factor (e.g. 0.5 M-2M NaCl, $MgCl_2$, or $CaCl_2$)) was then applied to increase the size of the complexes. The purification matrix, environmental factor, and cellular supernatant were incubated at room temperature for 15 minutes. Subsequently, the purification matrix, environmental factor, and cellular supernatant were concentrated (5-50 fold) using a 13 $cm^2$ hollow filter (0.2 µm pore size). Six wash diavolumes were performed using phosphate buffer solution and sodium chloride. This protocol allowed for separation of the purification matrix, with AAVs bound from impurities on the basis of size. The AAVs were eluted from the purification matrix by applying a buffer (e.g., the second environmental factor). The purification matrix was collected from the retentate. Various buffers were evaluated as shown in Table 5. The AAVs are then titered and frozen at −80° C. for future use.

TABLE 5

| | Buffers employed as the "second environmental factor" | |
|---|---|---|
| Environmental Factor | Composition of Second Environmental Factor | |
| A | 0.5M Arginine (pH = 2); 0.6M NaCl | |
| B | 0.1M Glycine (pH = 2); 0.6M NaCl | |
| C | 0.1M Glycine (pH = 2); 0.6M MgCl$_2$ | |
| D | 0.1M Glycine (pH = 2); 0.6M CaCl$_2$ | |

Quantitative real-time polymerase chain reaction (qPCR) was utilized to evaluate the amount of AAV captured from solution and the amount of AAV obtained after elution. The purification matrix captured greater than 99% of AAV particles of multiple serotypes (AAV1, AAV2, AAV6, AAV8, and AAV9) (FIG. 23). Each buffer evaluated eluted over 65% of bound AAV particles in a single diavolume (FIG. 24).

The purification matrix was recycled after elution of the AAV particles to determine whether or not it could be utilized for future purifications. Recycling was performed by incubating the purification matrix at 95° C. for 5 minutes or soaking the purification matrix in 1 M NaOH or 6 M guanidine hydrochloride for five minutes.

As Table 6 shows, the purification matrix can be regenerated and utilized for repeated capture. After five cycles of purification/regeneration, the purification matrix captures 98% of AAV.

TABLE 6

| | Recycling of Purification Matrix | |
|---|---|---|
| # of times purification matrix has been used | Captured viral genome (vg)/ milliliter (mL) | % Capture |
| 1 | 8.46 × 10$^{10}$ | 97 |
| 2 | 8.60 × 10$^{10}$ | 98 |
| 3 | 8.61 × 10$^{10}$ | 99 |
| 4 | 8.57 × 10$^{10}$ | 98 |
| 5 | 8.53 × 10$^{10}$ | 98 |

Sodium dodecycl sulfate-polyacrylamide gel electrophoresis (SDS-PAGE) was utilized to evaluate the purity of the eluted AAV samples. The gels were then silver stained, to visualize any contaminants in the sample. As shown in FIG. 25, the major AAV structural proteins Vp1, Vp2, and Vp3 were visible on the gel, but no other major bands were observed. A Western Blot confirmed the presence of capsid proteins in the sample that had been eluted from the purification matrix (FIG. 26). Furthermore, after the AAV particles were captured by the purification matrix, no AAV particles remained in the capture supernatant (Capture Sup of FIG. 26). Taken together, this data indicates that, after elution from the purification matrix, substantially all contaminants have been removed from the sample, and the isolated AAV has a high degree of purity.

In a subsequent experiment, it was evaluated whether the purification matrix is able to capture full capsids, empty capsids, or both. Total number of AAV capsids present in samples eluted from the purification matrix was estimated using an ELISA-based assay. The eluted samples were also evaluated using qPCR, to determine the number of viral genomes. A qPCR: ELISA value was used to approximate the ratio of full capsids relative to total capsids. As shown in Table 7, the purification matrix enriched for full capsids.

TABLE 7

| | Enrichment for Full AAV Capsid | | | |
|---|---|---|---|---|
| Method | Starting Quantity | Capture % | Elution Quantity | Change in Full % |
| qPCR | 5.78 × 10$^{10}$ | 99.2 | 5.73 × 10$^{10}$ | 33% → 70% |
| ELISA | 1.76 × 10$^{11}$ | 99.9 | 8.14 × 10$^{10}$ | |

The eluted AAV samples were also assayed to determine whether they maintained infectivity after purification. AAV8 carrying a tdTomato transgene was administered to HEK293 cells (10,000 cells/well) in culture at a multiplicity of infection (MOI) 1×10$^6$ or 1×10$^7$. After 48 of incubation, the cells were visualized for tdTomato fluorescence using fluorescence microscopy. As shown in FIG. 27A, AAV purified by the purification matrix (ViraTag™) infected cells to a similar extent as AAVs purified according to standard protocols (Pos Ctrl). This data was quantified, as shown in FIG. 27B. There was no statistically significant difference between infectivity levels of the AAV8 purified by standard protocols (Pos Ctrl) and the AAV8 purified by the purification matrix (ViraTag™). Accordingly, this data shows that AAV particles purified using the tested purification matrix (ViraTag™) retain high levels of infectivity.

NUMBERED EMBODIMENTS

Notwithstanding the appended claims, the disclosure sets forth the following numbered embodiments:

Method of Purifying a Biologic from a Contaminant

1. A method of purifying a biologic comprising contacting the biologic with a protein-based purification matrix; wherein the biologic binds to the purification matrix to form a complex; wherein the size of the complex is increased by a first environmental factor; wherein the complex is separated from at least one contaminant on the basis of size; and wherein the biologic is separated from the purification matrix by a second environmental factor.

2. The method of embodiment 1, wherein the purification matrix comprises (i) a capture domain which binds to the biologic, and (ii) a polypeptide with phase behavior, wherein the capture domain is coupled to the polypeptide with phase behavior.

3. The method of embodiment 2, wherein the capture domain is coupled to the polypeptide with phase behavior via a linker.

4. The method of embodiment 3, wherein the linker is a peptide linker.

5. The method of embodiment 4, wherein the peptide linker comprises a protease cleavage site.

6. The method of embodiment 3, wherein the linker is a chemical linker.

7. The method of embodiment 1, wherein the purification matrix comprises a fusion protein comprising (i) a capture domain which binds to the biologic and (ii) a polypeptide with phase behavior.

8. The method of any one of embodiments 2-7, wherein the polypeptide with phase behavior is a resilin-like polypeptide.

9. The method of any one of embodiments 2-7, wherein the polypeptide with phase behavior is an elastin-like polypeptide.

10. The method of any one of 2-7 or 9, wherein the polypeptide with phase behavior is a polymer containing a pentapeptide repeat having the sequence (Val-Pro-Gly-Xaa-Gly)$_n$ (SEQ ID NO: 10), or a randomized, scrambled analog thereof; wherein Xaa can be any amino acid except proline.

11. The method of embodiment 10, wherein n is an integer from 1 to 360, inclusive of endpoints.

12. The method of any one of embodiments 2-7 or 9, wherein the polypeptide with phase behavior comprises an amino acid sequence selected from:

a. (GRGDSPY)$_n$ (SEQ ID NO: 1)
b. (GRGDSPH)$_n$ (SEQ ID NO: 2)
c. (GRGDSPV)$_n$ (SEQ ID NO: 3)
d. (GRGDSPYG)$_n$ (SEQ ID NO: 4)
e. (RPLGYDS)$_n$ (SEQ ID NO: 5)
f. (RPAGYDS)$_n$ (SEQ ID NO: 6)
g. (GRGDSYP)$_n$ (SEQ ID NO: 7)
h. (GRGDSPYQ)$_n$ (SEQ ID NO: 8)
i. (GRGNSPYG)$_n$ (SEQ ID NO: 9)
j. (GVGVP)$_n$ (SEQ ID NO: 11);
k. (GVGVPGLGVPGVGVPGLGVPGVGVP)$_m$ (SEQ ID NO: 12);
l. (GVGVPGVGVPGAGVPGVGVPGVGVP)$_m$ (SEQ ID NO: 13);
m. (GVGVPGWGVPGVGVPGWGVPGVGVP)$_m$ (SEQ ID NO: 14);
n. (GVGVPGVGVPGVGVPGVGVPGVGVPGVG VPGEGVPGFGVPGVGVP)$_m$ (SEQ ID NO: 15);
o. (GVGVPGVGVPGVGVPGVGVPGVGVPGVG VPGKGVPGFGVPGVGVP)$_m$ (SEQ ID NO: 16); and
p. (GAGVPGVGVPGAGVPGVGVPGAGVP)$_m$ (SEQ ID NO: 17);

or a randomized, scrambled analog thereof;
wherein:
n is an integer in the range of 20-360, inclusive of endpoints; and
m is an integer in the range of 4-25, inclusive of endpoints.

13. The method of any one of embodiments 2-7 or 9, wherein the polypeptide with phase behavior comprises an amino acid sequence selected from:

(a) (GVGVP)$_m$ (SEQ ID NO: 52);
(b) (ZZPXXXXGZ)$_m$ (SEQ ID NO: 57);
(c) (ZZPXGZ)$_m$ (SEQ ID NO: 58);
(d) (ZZPXXGZ)$_m$ (SEQ ID NO: 59); or
(e) (ZZPXXXGZ)$_m$ (SEQ ID NO: 60), wherein m is an integer between 10 and 160, inclusive of endpoints, wherein X if present is any amino acid except proline or glycine, and wherein Z if present is any amino acid.

14. The method of any one of embodiments 2-7 or 9, wherein the polypeptide with phase behavior comprises an amino acid sequence selected from:

(a) (GVGVPGVGVPGAGVPGVGVPGVGVP)$_m$ (SEQ ID NO: 53); or
(b) (GVGVPGVGVPGLGVPGVGVPGVGVP)$_m$ (SEQ ID NO: 55);

wherein m is an integer between 2 and 32, inclusive of endpoints.

15. The method of any one of embodiments 2-7 or 9, wherein the polypeptide with phase behavior comprises an amino acid sequence selected from:

(a) (GVGVPGVGVPGAGVPGVGVPGVGVP)$_m$ (SEQ ID NO: 193), wherein m is 8 or 16;

(b) (GVGVPGAGVP)$_m$ (SEQ ID NO: 54), wherein m is an integer between 5 and 80, inclusive of endpoints; or (c) (GXGVP)$_m$ (SEQ ID NO: 56), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

16. The method of any one of embodiments 2-15, wherein the capture domain comprises the sequence of any one of SEQ ID NO: 24-49, 62-148, 167-171 or a sequence having at least 1, at least 2, at least 3, at least 4, or at least 5 mutations relative thereto.

17. The method of any one of embodiments 2-15, wherein the binding of the biologic to the purification matrix is reversible.

18. The method of any one of embodiments 2-15, wherein the binding of the biologic to the purification matrix is non-covalent.

19. The method of any one of embodiments 2-15, wherein the binding of the biologic to the purification matrix is covalent.

20. The method of any one of embodiments 1-19, wherein the biologic is a lipid, a lipopolysaccharide, a cell, a protein, a nucleic acid, a carbohydrate, or a viral particle.

21. The method of embodiment 20, wherein the biologic is a cell.

22. The method of embodiment 21, wherein the cell is a bacterial cell, a yeast cell, or a mammalian cell.

23. The method of embodiment 21 or 22, wherein the cell is a stem cell, a bone cell, a blood cell, a muscle cell, a fat cell, a skin cell, a nerve cell, an endothelial cell, a sex cell, a pancreatic cell, or a cancer cell.

24. The method of embodiment 21 or 22, wherein the cell is an immune cell.

25. The method of embodiment 24, wherein the immune cell is a T cell, a B cell, a NK cell, a peripheral blood mononuclear cell, or a neutrophil.

26. The method of embodiment 25, wherein the cell is a T cell expressing a chimeric antigen receptor (CAR).

27. The method of embodiment 20, wherein the nucleic acid is a DNA or an RNA.

28 The method of embodiment 17, wherein the viral particle is an adenovirus particle, an adeno-associated virus (AAV) particle, a lentivirus particle, a retrovirus particle, a poxvirus particle, a measles virus particle, or a herpesvirus particle.

29. The method of any one of embodiments 1-28, wherein the biologic has a diameter between 1 nm and 100 μm, inclusive of the endpoints.

30. The method of embodiment 29, wherein the biologic has a diameter between 1 nm and 100 nm, inclusive of the endpoints.

31. The method of embodiment 29, wherein the biologic has a diameter between 100 nm and 1 μm, inclusive of the endpoints.

32. The method of embodiment 29, wherein the biologic has a diameter between 1 μm and 50 μm, inclusive of the endpoints.

33. The method of embodiment 29, wherein the biologic has a diameter between 50 μm and 100 μm, inclusive of the endpoints.

34. The method of any one of embodiments 1-33, wherein the method is completed in about 0.5 to about 24 hours.

35. The method of embodiment 34, wherein the method is completed in about 0.5 to about 8 hours.

36. The method of embodiment 34, wherein the method is completed in about 2 to about 6 hours.

37. The method of any one of embodiments 1-36, wherein the separation of the complex from the at least one contaminant can be observed visually with an unaided eye.

38. The method of any one of embodiments 1-37, wherein the increase in the size of the complex is at least a 2-fold increase.

39. The method of embodiment 38, wherein the increase in the size of the complex is at least a 10-fold increase.

40. The method of embodiment 38, wherein the increase in the size of the complex is at least a 25-fold increase.

41. The method of any one of embodiments 38-40, wherein the increase in size is an increase in the mass of the complex.

42. The method of any one of embodiments 38-40, wherein the increase in size is an increase in the diameter of the complex.

43. The method of any one of embodiments 1-42, wherein the first environmental factor comprises one or more of:
   a. a change in one or more of temperature, pH, salt concentration, concentration of the purification matrix, concentration of the biologic, or pressure;
   b. the addition of one or more surfactants, cofactor, vitamin, molecular crowding agents, reducing agents, oxidizing agents, enzymes, or denaturing agents; or
   c. the application of electromagnetic or acoustic waves.

44. The method of any one of embodiments 1-42, wherein the second environmental factor comprises one or more of:
   a. a change in one or more of temperature, pH, salt concentration, concentration of the purification matrix, concentration of the biologic, or pressure;
   b. the addition of one or more surfactants, molecular crowding agents, reducing agents, enzymes, denaturing agents, cofactor, vitamin, or oxidizing agents; or
   c. the application of electromagnetic or acoustic waves.

45. The method of any one of embodiments 1-44, wherein the separation on the basis of size is performed using tangential flow filtration, membrane chromatography, analytical ultracentrifugation, high performance liquid chromatography, membrane chromatography, normal flow filtration, acoustic wave separation, centrifugation, counterflow centrifugation, and fast protein liquid chromatography.

46. The method of any one of embodiments 1-45, wherein the at least one contaminant is selected from a solvent, an endotoxin, a protein, a peptide, a nucleic acid, and a carbohydrate.

47. The method of any one of embodiments 1-46, wherein the purification yield of the biologic is at least 70%, at least 80%, at least 90%, at least 95%, at least 96%, at least 97%, at least 98%, or at least 99%.

48. The method of any one of embodiments 1-47, wherein the biologic is purified to at least 70%, at least 80%, at least 90%, at least 95%, at least 96%, at least 97%, at least 98%, or at least 99% purity.

Method of Removing a Contaminant from a Composition Comprising a Biologic

1a. A method of removing a contaminant from a composition comprising a biologic, the method comprising contacting the contaminant with a protein-based purification matrix;
   wherein the contaminant binds to the matrix to form a complex;
   wherein the size of the complex is increased by a first environmental factor;
   wherein the complex is separated from the biologic on the basis of size; and
   wherein the contaminant is separated from the matrix by a second environmental factor.

2a. The method of embodiment 1a, wherein the purification matrix comprises (i) a capture domain which binds to the contaminant, and (ii) a polypeptide with phase behavior, wherein the capture domain is coupled to the polypeptide with phase behavior.

3a. The method of embodiment 2a, wherein the capture domain is coupled to the polypeptide with phase behavior via a linker.

4a. The method of embodiment 3a, wherein the linker is a peptide linker.

5a. The method of embodiment 4a, wherein the peptide linker comprises a protease cleavage site.

6a. The method of embodiment 3a, wherein the linker is a chemical linker.

7a. The method of embodiment 1a, wherein the purification matrix comprises a fusion protein comprising (i) a capture domain which binds to the contaminant and (ii) a polypeptide with phase behavior.

8a. The method of any one of embodiments 2a-7a, wherein the polypeptide with phase behavior is a resilin-like polypeptide.

9a. The method of any one of embodiments 2a-7a, wherein the polypeptide with phase behavior is an elastin-like polypeptide.

10a. The method of any one of 2a-7a or 9a, wherein the polypeptide with phase behavior is a polymer containing a pentapeptide repeat having the sequence (Val-Pro-Gly-Xaa-Gly)$_n$ (SEQ ID NO: 10), or a randomized, scrambled analog thereof; wherein Xaa can be any amino acid except proline.

11a. The method of embodiment 10a, wherein n is an integer from 1 to 360, inclusive of endpoints.

12a. The method of any one of embodiments 2a-7a or 9a, wherein the polypeptide with phase behavior comprises an amino acid sequence selected from:
   a. (GRGDSPY)$_n$ (SEQ ID NO: 1)
   b. (GRGDSPH)$_n$ (SEQ ID NO: 2)
   c. (GRGDSPV)$_n$ (SEQ ID NO: 3)
   d. (GRGDSPYG)$_n$ (SEQ ID NO: 4)
   e. (RPLGYDS)$_n$ (SEQ ID NO: 5)
   f. (RPAGYDS)$_n$ (SEQ ID NO: 6)
   g. (GRGDSYP)$_n$ (SEQ ID NO: 7)
   h. (GRGDSPYQ)$_n$ (SEQ ID NO: 8)
   i. (GRGNSPYG)$_n$ (SEQ ID NO: 9)
   j. (GVGVP)$_n$ (SEQ ID NO: 11);
   k. (GVGVPGLGVPGVGVPGLGVPGVGVP)$_m$ (SEQ ID NO: 12);
   l. (GVGVPGVGVPGAGVPGVGVPGVGVP)$_m$ (SEQ ID NO: 13);
   m. (GVGVPGWGVPGVGVPGWGVPGVGVP)$_m$ (SEQ ID NO: 14);
   n. (GVGVPGVGVPGVGVPGVGVPGVGVPG-VGVPGEGVPGFGVPGVGVP)$_m$ (SEQ ID NO: 15);

o. (GVGVPGVGVPGVGVPGVGVPGVGVPGV-GVPGKGVPGFGVPGVGVP)$_m$ (SEQ ID NO: 16); and p. (GAGVPGVGVPGAGVPGVGVPGAGVP)$_m$ (SEQ ID NO: 17);

or a randomized, scrambled analog thereof;

wherein:

n is an integer in the range of 20-360, inclusive of endpoints; and m is an integer in the range of 4-25, inclusive of endpoints.

13a. The method of any one of embodiments 2a-7a or 9a, wherein the polypeptide with phase behavior comprises an amino acid sequence selected from:

a. (GVGVP)$_m$ (SEQ ID NO: 52);

b. (ZZPXXXXGZ)$_m$ (SEQ ID NO: 57);

c. (ZZPXGZ)$_m$ (SEQ ID NO: 58);

d. (ZZPXXGZ)$_m$ (SEQ ID NO: 59); or e. (ZZPXXXGZ)$_m$ (SEQ ID NO: 60), wherein m is an integer between 10 and 160, inclusive of endpoints, wherein X if present is any amino acid except proline or glycine, and wherein Z if present is any amino acid.

14a. The method of any one of embodiments 2a-7a or 9a, wherein the polypeptide with phase behavior comprises an amino acid sequence selected from:

(a) (GVGVPGVGVPGAGVPGVGVPGVGVP)$_m$ (SEQ ID NO: 53); or (b) (GVGVPGVGVPGLGVPGVGVPGVGVP)$_m$ (SEQ ID NO: 55);

wherein m is an integer between 2 and 32, inclusive of endpoints.

15a. The method of any one of embodiments 2a-7a or 9a, wherein the polypeptide with phase behavior comprises an amino acid sequence selected from:

(a) (GVGVPGVGVPGAGVPGVGVPGVGVP)$_m$ (SEQ ID NO: 193), wherein m is 8 or 16;

(b) (GVGVPGAGVP)$_m$ (SEQ ID NO: 54), wherein m is an integer between 5 and 80, inclusive of endpoints; or (c) (GXGVP)$_m$ (SEQ ID NO: 56), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

16a. The method of any one of embodiments 2a-15a, wherein the capture domain comprises the sequence of any one of SEQ ID NO: 24-49, 62-148, or 167-171 or a sequence having at least 1, at least 2, at least 3, at least 4, or at least 5 mutations relative thereto.

17a. The method of any one of embodiments 1a-16a, wherein the binding of the contaminant to the purification matrix is reversible.

18a. The method of any one of embodiments 1a-16a, wherein the binding of the contaminant to the purification matrix is non-covalent.

19a. The method of any one of embodiments 1a-16a, wherein the binding of the contaminant to the purification matrix is covalent.

20a. The method of any one of embodiments 1a-19a, wherein the biologic is a lipid, lipopolysaccharide, cell, a protein, a nucleic acid, a carbohydrate, or a viral particle.

21a. The method of embodiment 20a, wherein the biologic is a cell.

22a. The method of embodiment 32a, wherein the cell is a bacterial cell, a yeast cell, or a mammalian cell.

23a. The method of embodiment 21a or 22a, wherein the cell is a stem cell, a bone cell, a blood cell, a muscle cell, a fat cell, a skin cell, a nerve cell, an endothelial cell, a sex cell, a pancreatic cell, or a cancer cell.

24a. The method of embodiments 21a or 22a, wherein the cell is an immune cell.

25a. The method of embodiment 24a, wherein the immune cell is a T cell, a B cell, a NK cell, a peripheral blood mononuclear cell, or a neutrophil.

26a. The method of embodiment 25a, wherein the cell is a T cell expressing a chimeric antigen receptor (CAR).

27a. The method of embodiment 20a, wherein the nucleic acid is a DNA or an RNA.

28a. The method of embodiment 20a, wherein the viral particle is an adenovirus particle, an adeno-associated virus (AAV) particle, a lentivirus particle, a retrovirus particle, a poxvirus particle, a measles virus particle, or a herpesvirus particle.

29a. The method of any one of embodiments 1a-28a, wherein the biologic has a diameter between 1 nm and 100 μm, inclusive of the endpoints.

30a. The method of embodiment 29a, wherein the biologic has a diameter between 1 nm and 100 nm, inclusive of the endpoints.

31a. The method of embodiment 29a, wherein the biologic has a diameter between 100 nm and 1 μm, inclusive of the endpoints.

32a. The method of embodiment 29a, wherein the biologic has a diameter between 1 μm and 50 μm, inclusive of the endpoints.

33a. The method of embodiment 29a, wherein the biologic has a diameter between 50 μm and 100 μm, inclusive of the endpoints.

34a. The method of any one of embodiments 1a-33a, wherein the method is completed in about 0.5 to about 24 hours.

35a. The method of embodiment 34a, wherein the method is completed in about 0.5 to about 8 hours.

36a. The method of embodiment 34a, wherein the method is completed in about 2 to about 6 hours.

37a. The method of any one of embodiments 1a-36a, wherein the separation of the complex from the composition comprising a biologic can be observed visually with an unaided eye.

38a. The method of any one of embodiments 1a-37a, wherein the increase in the size of the complex is at least a 2-fold increase.

39a. The method of embodiment 80a, wherein the increase in the size of the complex is at least a 10-fold increase.

40a. The method of embodiment 39a, wherein the increase in the size of the complex is at least a 25-fold increase.

41a. The method of any one of embodiments 38a-40a, wherein the increase in size is an increase in the mass of the complex.

42a. The method of any one of embodiments 38a-40a, wherein the increase in size is an increase in the diameter of the complex.

43a. The method of any one of embodiments 1a-42a, wherein the first environmental factor comprises one or more of:

a. a change in one or more of temperature, pH, salt concentration, concentration of the purification matrix, concentration of the biologic, or pressure;

b. the addition of one or more surfactants, molecular crowding agents, reducing agents, oxidizing agents, enzymes, cofactor, vitamin, or denaturing agents; or c. the application of electromagnetic or acoustic waves.

44a. The method of any one of embodiments 1a-42a, wherein the second environmental factor comprises one or more of:

a. a change in one or more of temperature, pH, salt concentration, concentration of the purification matrix, concentration of the biologic, or pressure;

b. the addition of one or more surfactants, molecular crowding agents, reducing agents, oxidizing agents, enzymes, cofactor, vitamin, or denaturing agents; or c. the application of electromagnetic or acoustic waves.

45a. The method of any one of embodiments 1a-44a, wherein the separation on the basis of size is performed using tangential flow filtration, analytical ultracentrifugation, membrane chromatography, high performance liquid chromatography, normal flow filtration, acoustic wave separation, centrifugation, counterflow centrifugation, and fast protein liquid chromatography.

46a. The method of any one of embodiments 1a-45a, wherein the contaminant is selected from a solvent, an endotoxin, a protein, a peptide, a nucleic acid, and a carbohydrate.

47a. The method of any one of embodiments 1a-46a, wherein at least 70%, at least 80%, at least 90%, at least 95%, at least 96%, at least 97%, at least 98%, or at least 99% of the contaminant is removed.

Method of Purifying a Biologic from a Contaminant

1b. A method of purifying a biologic, the method comprising contacting the biologic with a protein-based purification matrix;

wherein the biologic binds to the matrix to form a complex;

wherein the size of the complex is increased;

wherein the complex is separated from at least one contaminant on the basis of size; and wherein the biologic is separated from the matrix by an environmental factor.

2b. The method of embodiment 1b, wherein the purification matrix comprises (i) a capture domain which binds to the biologic, and (ii) a polypeptide with phase behavior, wherein the capture domain is coupled to the polypeptide with phase behavior.

3b. The method of embodiment 2b, wherein the capture domain is coupled to the polypeptide with phase behavior via a linker.

4b. The method of embodiment 3b, wherein the linker is a peptide linker.

5b. The method of embodiment 4b, wherein the peptide linker comprises a protease cleavage site.

6b. The method of embodiment 3b, wherein the linker is a chemical linker.

7b. The method of embodiment 1b, wherein the purification matrix comprises a fusion protein comprising (i) a capture domain which binds to the biologic and (ii) a polypeptide with phase behavior.

8b. The method of any one of embodiments 2b-7b, wherein the polypeptide with phase behavior is a resilin-like polypeptide.

9b. The method of any one of embodiments 2b-7b, wherein the polypeptide with phase behavior is an elastin-like polypeptide.

10b. The method of any one of 2b-7b or 9b, wherein the polypeptide with phase behavior is a polymer containing a pentapeptide repeat having the sequence (Val- Pro-Gly-Xaa-Gly)$_n$ (SEQ ID NO: 10), or a randomized, scrambled analog thereof; wherein Xaa can be any amino acid except proline.

11b. The method of embodiment 10b, wherein n is an integer from 1 to 360, inclusive of endpoints.

12b. The method of any one of embodiments 2b-7b or 9b, wherein the polypeptide with phase behavior comprises an amino acid sequence selected from:

a. (GRGDSPY)$_n$ (SEQ ID NO: 1)

b. (GRGDSPH)$_n$ (SEQ ID NO: 2)

c. (GRGDSPV)$_n$ (SEQ ID NO: 3)

d. (GRGDSPYG)$_n$ (SEQ ID NO: 4)

e. (RPLGYDS)$_n$ (SEQ ID NO: 5)

f. (RPAGYDS)$_n$ (SEQ ID NO: 6)

g. (GRGDSYP)$_n$ (SEQ ID NO: 7)

h. (GRGDSPYQ)$_n$ (SEQ ID NO: 8)

i. (GRGNSPYG)$_n$ (SEQ ID NO: 9)

j. (GVGVP)$_n$ (SEQ ID NO: 11);

k. (GVGVPGLGVPGVGVPGLGVPGVGVP)$_m$ (SEQ ID NO: 12);

l. (GVGVPGVGVPGAGVPGVGVPGVGVP)$_m$ (SEQ ID NO: 13);

m. (GVGVPGWGVPGVGVPGWGVPGVGVP)$_m$ (SEQ ID NO: 14);

n. (GVGVPGVGVPGVGVPGVGVPGVGVPGV-GVPGEGVPGFGVPGVGVP)$_m$ (SEQ ID NO: 15);

o. (GVGVPGVGVPGVGVPGVGVPGVGVPGV-GVPGKGVPGFGVPGVGVP)$_m$ (SEQ ID NO: 16); and p. (GAGVPGVGVPGAGVPGVGVPGAGVP)$_m$ (SEQ ID NO: 17);

or a randomized, scrambled analog thereof;

wherein:

n is an integer in the range of 20-360, inclusive of endpoints; and m is an integer in the range of 4-25, inclusive of endpoints.

13b. The method of any one of embodiments 2b-7b or 9b, wherein the polypeptide with phase behavior comprises an amino acid sequence selected from:

a. (GVGVP)$_m$ (SEQ ID NO: 52);

b. (ZZPXXXXGZ)$_m$ (SEQ ID NO: 57);

c. (ZZPXGZ)$_m$ (SEQ ID NO: 58);

d (ZZPXXGZ)$_m$ (SEQ ID NO: 59); or e. (ZZPXXXGZ)$_m$ (SEQ ID NO: 60), wherein m is an integer between 10 and 160, inclusive of endpoints, wherein X if present is any amino acid except proline or glycine, and wherein Z if present is any amino acid.

14b. The method of any one of embodiments 2b-7b or 9b, wherein the polypeptide with phase behavior comprises an amino acid sequence selected from:

(a) (GVGVPGVGVPGAGVPGVGVPGVGVP)$_m$ (SEQ ID NO: 53); or (b) (GVGVPGVGVPGLGVPGVGVPGVGVP)$_m$ (SEQ ID NO: 55);

wherein m is an integer between 2 and 32, inclusive of endpoints.

15b. The method of any one of embodiments 2b-7b or 9b, wherein the polypeptide with phase behavior comprises an amino acid sequence selected from:

(a) (GVGVPGVGVPGAGVPGVGVPGVGVP)$_m$ (SEQ ID NO: 193), wherein m is 8 or 16;

(b) (GVGVPGAGVP)$_m$ (SEQ ID NO: 54), wherein m is an integer between 5 and 80, inclusive of endpoints; or

(c) (GXGVP)$_m$ (SEQ ID NO: 56), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

16b. The method of any one of embodiments 2b-15b, wherein the capture domain comprises the sequence of any one of SEQ ID NO: 24-49, 62-148, or 167-171 or a sequence having at least 1, at least 2, at least 3, at least 4, or at least 5 mutations relative thereto.

17b. The method of any one of embodiments 1b-16b, wherein the binding of the biologic to the purification matrix is reversible.

18b. The method of any one of embodiments 1b-16b, wherein the binding of the biologic to the purification matrix is non-covalent.

19b. The method of any one of embodiments 1b-16b, wherein the binding of the biologic to the purification matrix is covalent.

20b. The method of any one of embodiments 1b-19b, wherein the biologic is a lipid, lipopolysaccharide, cell, a protein, a nucleic acid, a carbohydrate, or a viral particle.

21b. The method of embodiment 20b, wherein the biologic is a cell.

22b. The method of embodiment 21b, wherein the cell is a bacterial cell, a yeast cell, or a mammalian cell.

23b. The method of embodiment 21b or 22b, wherein the cell is a stem cell, a bone cell, a blood cell, a muscle cell, a fat cell, a skin cell, a nerve cell, an endothelial cell, a sex cell, a pancreatic cell, or a cancer cell.

24b. The method of any one of embodiments 21b or 22b, wherein the cell is an immune cell.

25b. The method of embodiment 24b, wherein the immune cell is a T cell, a B cell, a NK cell, a peripheral blood mononuclear cell, or a neutrophil.

26b. The method of embodiment 25b, wherein the cell is a T cell expressing a chimeric antigen receptor (CAR).

27b. The method of embodiment 20b, wherein the nucleic acid is a DNA or an RNA.

28b. The method of embodiment 20b, wherein the virus is an adenovirus particle, an adeno-associated virus (AAV) particle, a lentivirus particle, a retrovirus particle, a poxvirus particle, a measles virus particle, or a herpesvirus particle.

29b. The method of any one of embodiments 1b-28b, wherein the biologic has a diameter between 1 nm and 100 μm, inclusive of the endpoints.

30b. The method of embodiment 29b, wherein the biologic has a diameter between 1 nm and 100 nm, inclusive of the endpoints.

31b. The method of embodiment 29b, wherein the biologic has a diameter between 100 nm and 1 μm, inclusive of the endpoints.

32b. The method of embodiment 29b, wherein the biologic has a diameter between 1 μm and 50 μm, inclusive of the endpoints.

33b. The method of embodiment 29b, wherein the biologic has a diameter between 50 μm and 100 μm, inclusive of the endpoints.

34b. The method of any one of embodiments 1b-33b, wherein the method is completed in about 0.5 to about 24 hours.

35b. The method of embodiment 34b, wherein the method is completed in about 0.5 to about 8 hours.

36b. The method of embodiment 34b, wherein the method is completed in about 2 to about 6 hours.

37b. The method of any one of embodiments 1b-36b, wherein the separation of the complex from the at least one contaminant can be observed visually with an unaided eye.

38b. The method of any one of embodiments 1b-37b, wherein the increase in the size of the complex is at least a 2-fold increase.

39b. The method of embodiment 38b, wherein the increase in the size of the complex is at least a 10-fold increase.

40b. The method of embodiment 39b, wherein the increase in the size of the complex is at least a 25-fold increase.

41b. The method of any one of embodiments 38b-40b, wherein the increase in size is an increase in the mass of the complex.

42b. The method of any one of embodiments 38b-40b, wherein the increase in size is an increase in the diameter of the complex.

43b. The method of any one of embodiments 1b-42b, wherein the environmental factor comprises one or more of:

a. a change in one or more of temperature, pH, salt concentration, concentration of the purification matrix, concentration of the biologic, or pressure;

b. the addition of one or more surfactants, molecular crowding agents, reducing agents, oxidizing agents, enzymes, cofactor, vitamin, or denaturing agents; or c. the application of electromagnetic or acoustic waves.

44b. The method of any one of embodiments 1b-43b, wherein the separation on the basis of size is performed using tangential flow filtration, analytical ultracentrifugation, membrane chromatography, high performance liquid chromatography, normal flow filtration, acoustic wave separation, centrifugation, counterflow centrifugation, and fast protein liquid chromatography.

45b. The method of any one of embodiments 1b-44b, wherein the at least one contaminant is selected from a solvent, an endotoxin, a protein, a peptide, a nucleic acid, and a carbohydrate.

46b. The method of any one of embodiments 1b-45b, wherein the purification yield of the biologic is at least 70%, at least 80%, at least 90%, at least 95%, at least 96%, at least 97%, at least 98%, or at least 99%.

47b. The method of any one of embodiments 1b-46b, wherein the biologic is purified to at least 70%, at least 80%, at least 90%, at least 95%, at least 96%, at least 97%, at least 98%, or at least 99% purity.

Method of Separating a First Biologic from a Second Biologic

1c. A method of separating a first biologic from a second biologic, the method comprising contacting the first biologic with a first protein-based purification matrix and contacting the second biologic with a second protein-based purification matrix; wherein the first biologic binds to the first purification matrix to form a first complex; wherein the second biologic binds to the second purification matrix to form a second complex; and separating the first biologic from the second biologic by applying an environmental factor.

2c. The method of embodiment 1c, wherein the first purification matrix comprises (i) a capture domain which binds to the biologic, and (ii) a polypeptide with phase behavior, wherein the capture domain is coupled to the polypeptide with phase behavior.

3c. The method of embodiment 1c, wherein the second purification matrix comprises (i) a capture domain which binds to the biologic, and (ii) a polypeptide with phase behavior, wherein the capture domain is coupled to the polypeptide with phase behavior.

4c. The method of embodiment 2c or 3c, wherein the capture domain is coupled to the polypeptide with phase behavior via a linker.

5c. The method of embodiment 4c, wherein the linker is a peptide linker.

6c. The method of embodiment 5c, wherein the peptide linker comprises a protease cleavage site.

7c. The method of embodiment 4c, wherein the linker is a chemical linker.

8c. The method of embodiment 1c, wherein the first purification matrix comprises a fusion protein comprising (i) a capture domain which binds to the biologic and (ii) a polypeptide with phase behavior.

9c. The method of embodiment 2c, wherein the second purification matrix comprises a fusion protein comprising (i) a capture domain which binds to the biologic and (ii) a polypeptide with phase behavior.

10c. The method of any one of embodiments 2c-9c, wherein the polypeptide with phase behavior is a resilin-like polypeptide.

11c. The method of any one of embodiments 2c-9c, wherein the polypeptide with phase behavior is an elastin-like polypeptide.

12c. The method of any one of embodiments 2c-9c or 11c, wherein the polypeptide with phase behavior is a polymer containing a pentapeptide repeat having the sequence (Val-Pro-Gly-Xaa-Gly)$_n$ (SEQ ID NO: 10), or a randomized, scrambled analog thereof; wherein Xaa can be any amino acid except proline.

13c. The method of embodiment 12c, wherein n is an integer from 1 to 360, inclusive of endpoints.

14c. The method of any one of embodiments embodiments 2c-9c or 11c, wherein the polypeptide with phase behavior comprises an amino acid sequence selected from:
a. (GRGDSPY)$_n$ (SEQ ID NO: 1)
b. (GRGDSPH)$_n$ (SEQ ID NO: 2)
c. (GRGDSPV)$_n$ (SEQ ID NO: 3)
d. (GRGDSPYG)$_n$ (SEQ ID NO: 4)
e. (RPLGYDS)$_n$ (SEQ ID NO: 5)
f. (RPAGYDS)$_n$ (SEQ ID NO: 6)
g (GRGDSYP)$_n$ (SEQ ID NO: 7)
h. (GRGDSPYQ)$_n$ (SEQ ID NO: 8)
i. (GRGNSPYG)$_n$ (SEQ ID NO: 9)
j. (GVGVP)$_n$ (SEQ ID NO: 11);
k. (GVGVPGLGVPGVGVPGLGVPGVGVP)$_m$ (SEQ ID NO: 12);
l. (GVGVPGVGVPGAGVPGVGVPGVGVP)$_m$ (SEQ ID NO: 13);
m. (GVGVPGWGVPGVGVPGWGVPGVGVP)$_m$ (SEQ ID NO: 14);
n. (GVGVPGVGVPGVGVPGVGVPGVGVPGV-GVPGEGVPGFGVPGVGVP)$_m$ (SEQ ID NO: 15);
o. (GVGVPGVGVPGVGVPGVGVPGVGVPGV-GVPGKGVPGFGVPGVGVP)$_m$ (SEQ ID NO: 16); and
p. (GAGVPGVGVPGAGVPGVGVPGAGVP)$_m$ (SEQ ID NO: 17);
or a randomized, scrambled analog thereof;

wherein:
n is an integer in the range of 20-360, inclusive of endpoints; and
m is an integer in the range of 4-25, inclusive of endpoints.

15c. The method of any one of embodiments 2c-9c or 11c, wherein the polypeptide with phase behavior comprises an amino acid sequence selected from:
a. (GVGVP)$_m$ (SEQ ID NO: 52);
b. (ZZPXXXXGZ)$_m$ (SEQ ID NO: 57);
c. (ZZPXGZ)$_m$ (SEQ ID NO: 58);
d. (ZZPXXGZ)$_m$ (SEQ ID NO: 59); or
e. (ZZPXXXGZ)$_m$ (SEQ ID NO: 60),
wherein m is an integer between 10 and 160, inclusive of endpoints, wherein X if present is any amino acid except proline or glycine, and wherein Z if present is any amino acid.

16c. The method of any one of embodiments 2c-9c or 11c, wherein the polypeptide with phase behavior comprises an amino acid sequence selected from:
(a) (GVGVPGVGVPGAGVPGVGVPGVGVP)$_m$ (SEQ ID NO: 53); or
(b) (GVGVPGVGVPGLGVPGVGVPGVGVP)$_m$ (SEQ ID NO: 55);
wherein m is an integer between 2 and 32, inclusive of endpoints.

17c. The method of any one of embodiments 2c-9c or 11c, wherein the polypeptide with phase behavior comprises an amino acid sequence selected from:
(a) (GVGVPGVGVPGAGVPGVGVPGVGVP)$_m$ (SEQ ID NO: 193), wherein m is 8 or 16;
(b) (GVGVPGAGVP)$_m$ (SEQ ID NO: 54), wherein m is an integer between 5 and 80, inclusive of endpoints; or
(c) (GXGVP)$_m$ (SEQ ID NO: 56), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

18c. The method of any one of embodiments 2c-17c, wherein the capture domain comprises the sequence of any one of SEQ ID NO: 24-49 and 62-148 and 167-171, or a sequence having at least 1, at least 2, at least 3, at least 4, or at least 5 mutations relative thereto.

19c. The method of any one of embodiments 1c-17c, wherein the binding of the first biologic and/or the second biologic to the purification matrix is reversible.

20c. The method of any one of embodiments 1c-17c, wherein the binding of the first biologic and/or the second biologic to the purification matrix is non-covalent.

21c. The method of any one of embodiments 1c-17c, wherein the binding of the first biologic and/or the second biologic to the purification matrix is covalent.

22c. The method of any one of embodiments 1c-21c, wherein the first biologic and/or the second biologic is selected from a cell, a protein, a lipid, a lipopolysaccharide, a nucleic acid, or a viral particle.

23c. The method of embodiment 22c, wherein the first biologic and/or the second biologic is a cell.

24c. The method of embodiment 23c, wherein the cell is a bacterial cell, a yeast cell, or a mammalian cell.

25c. The method of embodiment 23c or 24c, wherein the cell is a stem cell, a bone cell, a blood cell, a muscle cell, a fat cell, a skin cell, a nerve cell, an endothelial cell, a sex cell, a pancreatic cell, or a cancer cell.

26c. The method of embodiment 23c or 24c, wherein the cell is an immune cell.

27c. The method of embodiment 26c, wherein the immune cell is a T cell, a B cell, a NK cell, a peripheral blood mononuclear cell, or a neutrophil.

28c. The method of embodiment 27c, wherein the cell is a T cell expressing a chimeric antigen receptor (CAR).

29c. The method of embodiment 22c, wherein the nucleic acid is a DNA or an RNA.

30c. The method of embodiment 22c, wherein the viral particle is an adenovirus particle, an adeno-associated virus (AAV) particle, a lentivirus particle, a retrovirus particle, a poxvirus particle, a measles virus particle or a herpesvirus particle.

31c. The method of any one of embodiments 1c-30c, wherein the first biologic and/or second biologic has a diameter between 1 nm and 100 μm, inclusive of the endpoints.

32c. The method of embodiment 31c, wherein the first biologic and/or second biologic has a diameter between 1 nm and 100 nm, inclusive of the endpoints.

33c. The method of embodiment 31c, wherein the first biologic and/or second biologic has a diameter between 100 nm and 1 μm, inclusive of the endpoints.

34c. The method of embodiment 31c, wherein the first biologic and/or second biologic has a diameter between 1 μm and 50 μm, inclusive of the endpoints.

35c. The method of embodiment 31c, wherein the first biologic and/or second biologic has a diameter between 50 μm and 100 μm, inclusive of the endpoints.

36c. The method of any one of embodiments 1c-35c, wherein the method is completed in about 0.5 to about 24 hours.

37c. The method of embodiment 36c, wherein the method is completed in about 0.5 to about 8 hours.

38c. The method of embodiment 36c, wherein the method is completed in about 2 to about 6 hours.

39c. The method of any one of embodiments 1c-38c, wherein the separation of the first complex from the second complex can be observed visually with an unaided eye.

40c. The method of any one of embodiments 1c-39c, wherein the increase in the size of the first complex and/or second complex is at least a 2-fold increase.

41c. The method of any one of embodiments 1c-40c, wherein the increase in the size of the first complex and/or second complex is at least a 10-fold increase.

42c. The method of any one of embodiments 1c-41c, wherein the increase in the size of the first complex and/or second complex is at least a 25-fold increase.

43c. The method of any one of embodiments 40c-42c, wherein the increase in size is an increase in the mass of the complex.

44c. The method of any one of embodiments 40c-42c, wherein the increase in size is an increase in the diameter of the complex.

45c. The method of any one of embodiments 1c-44c, wherein the environmental factor comprises one or more of:

a. a change in one or more of temperature, pH, salt concentration, concentration of the purification matrix, concentration of the biologic, or pressure;

b. the addition of one or more surfactants, molecular crowding agents, reducing agents, oxidizing agents, enzymes, or denaturing agents; or c. the application of electromagnetic or acoustic waves.

46c. The method of any one of embodiments 1c-45c, wherein the separation on the basis of size is performed using tangential flow filtration, analytical ultracentrifugation, membrane chromatography, high performance liquid chromatography, and fast protein liquid chromatography.

47c. The method of any one of embodiments 1c-46c, wherein the purification yield of the first biologic is at least 70%, at least 80%, at least 90%, at least 95%, at least 96%, at least 97%, at least 98%, or at least 99%.

48c. The method of any one of embodiments 1c-47c, wherein the purification yield of the second biologic is at least 70%, at least 80%, at least 90%, at least 95%, at least 96%, at least 97%, at least 98%, or at least 99%.

a Method of Bringing a First Biologic into Proximity with a Second Biologic

1d. A method of bringing a first biologic into proximity with a second biologic, the method comprising contacting the first biologic with a first protein-based purification matrix and contacting the second biologic with a second protein-based purification matrix;

wherein the first biologic binds to the first purification matrix to form a first complex;

wherein the second biologic binds to the second purification matrix to form a second complex; and wherein an environmental factor brings the first complex and the second complex into proximity with one another.

2d. The method of embodiment 1d, wherein the first purification matrix comprises (i) a capture domain which binds to the biologic, and (ii) a polypeptide with phase behavior, wherein the capture domain is coupled to the polypeptide with phase behavior.

3d. The method of embodiment 1d, wherein the second purification matrix comprises (i) a capture domain which binds to the biologic, and (ii) a polypeptide with phase behavior, wherein the capture domain is coupled to the polypeptide with phase behavior.

4d. The method of embodiment 2d or 3d, wherein the capture domain is coupled to the polypeptide with phase behavior via a linker.

5d. The method of embodiment 4d, wherein the linker is a peptide linker.

6d. The method of embodiment 5d, wherein the peptide linker comprises a protease cleavage site 7d. The method of embodiment 4d, wherein the linker is a chemical linker.

8d. The method of embodiment 1d, wherein the first purification matrix comprises a fusion protein comprising (i) a capture domain which binds to the biologic and (ii) a polypeptide with phase behavior.

9d. The method of embodiment 1d, wherein the second purification matrix comprises a fusion protein comprising (i) a capture domain which binds to the biologic and (ii) a polypeptide with phase behavior.

10d. The method of any one of embodiments 1d-9d, wherein the polypeptide with phase behavior is a resilin-like polypeptide.

11d. The method of any one of embodiments 1d-9d, wherein the polypeptide with phase behavior is an elastin-like polypeptide.

12d. The method of any one of embodiments 1d-9d or 11d, wherein the polypeptide with phase behavior is a polymer containing a pentapeptide repeat having the sequence $(Val\text{-}Pro\text{-}Gly\text{-}Xaa\text{-}Gly)_n$ (SEQ ID NO: 10), or a randomized, scrambled analog thereof; wherein Xaa can be any amino acid except proline.

13d. The method of embodiment 12d, wherein n is an integer from 1 to 360, inclusive of endpoints.

14d. The method of any one of embodiments 1d-9d or 11d, wherein the polypeptide with phase behavior comprises an amino acid sequence selected from:

a. $(GRGDSPY)_n$ (SEQ ID NO: 1)

b $(GRGDSPH)_n$ (SEQ ID NO: 2)

c. $(GRGDSPV)_n$ (SEQ ID NO: 3)

d. $(GRGDSPYG)_n$ (SEQ ID NO: 4)

e. $(RPLGYDS)_n$ (SEQ ID NO: 5)

f. $(RPAGYDS)_n$ (SEQ ID NO: 6)

g. $(GRGDSYP)_n$ (SEQ ID NO: 7)

h. $(GRGDSPYQ)_n$ (SEQ ID NO: 8)

i. $(GRGNSPYG)_n$ (SEQ ID NO: 9)

j. $(GVGVP)_n$ (SEQ ID NO: 11);

k. $(GVGVPGLGVPGVGVPGLGVPGVGVP)_m$ (SEQ ID NO: 12);

l. $(GVGVPGVGVPGAGVPGVGVPGVGVP)_m$ (SEQ ID NO: 13);

m. $(GVGVPGWGVPGVGVPGWGVPGVGVP)_m$ (SEQ ID NO: 14);

n. $(GVGVPGVGVPGVGVPGVGVPGVGVPG-VGVPGEGVPGFGVPGVGVP)_m$ (SEQ ID NO: 15);

o. $(GVGVPGVGVPGVGVPGVGVPGVGVP-GVGVPGKGVPGFGVPGVGVP)_m$ (SEQ ID NO: 16); and p. $(GAGVPGVGVPGAGVPGVGVPGAGVP)_m$ (SEQ ID NO: 17);

or a randomized, scrambled analog thereof;

wherein:

n is an integer in the range of 20-360, inclusive of endpoints; and m is an integer in the range of 4-25, inclusive of endpoints.

15d. The method of any one of embodiments 1d-9d or 11d, wherein the polypeptide with phase behavior comprises an amino acid sequence selected from:

a. $(GVGVP)_m$ (SEQ ID NO: 52);

b $(ZZPXXXXGZ)_m$ (SEQ ID NO: 57);

c. $(ZZPXGZ)_m$ (SEQ ID NO: 58);

d. $(ZZPXXGZ)_m$ (SEQ ID NO: 59); or e. $(ZZPXXXGZ)_m$ (SEQ ID NO: 60), wherein m is an integer between 10 and 160, inclusive of endpoints, wherein X if present is any amino acid except proline or glycine, and wherein Z if present is any amino acid.

16d. The method of any one of embodiments 1d-9d or 11d, wherein the polypeptide with phase behavior comprises an amino acid sequence selected from:

(a) $(GVGVPGVGVPGAGVPGVGVPGVGVP)_m$ (SEQ ID NO: 53); or (b) $(GVGVPGVGVPGLGVPGVGVPGVGVP)_m$ (SEQ ID NO: 55);

wherein m is an integer between 2 and 32, inclusive of endpoints.

17d. The method of any one of embodiments 1d-9d or 11d, wherein the polypeptide with phase behavior comprises an amino acid sequence selected from:

(a) $(GVGVPGVGVPGAGVPGVGVPGVGVP)_m$ (SEQ ID NO: 193), wherein m is 8 or 16;

(b) $(GVGVPGAGVP)_m$ (SEQ ID NO: 54), wherein m is an integer between 5 and 80, inclusive of endpoints; or (c) $(GXGVP)_m$ (SEQ ID NO: 56), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

18d. The method of any one of embodiments 2d-17d, wherein the capture domain comprises the sequence of any one of SEQ ID NO: 24-49 and 62-148 and 167-171, or a sequence having at least 1, at least 2, at least 3, at least 4, or at least 5 mutations relative thereto.

19d. The method of any one of embodiments 1d-18d, wherein the binding of the first biologic and/or second biologic to the purification matrix is reversible.

20d. The method of any one of embodiments 1d-18d, wherein the binding of the first biologic and/or second biologic to the purification matrix is non-covalent.

21d. The method of any one of embodiments 1d-18d, wherein the binding of the first biologic and/or second biologic to the purification matrix is covalent.

22d. The method of any one of embodiments 1d-21d, wherein the first biologic and/or second biologic is selected from a cell, a protein, a lipid, a lipopolysaccharide, a nucleic acid, a carbohydrate, or a viral particle.

23d. The method of embodiment 22d, wherein the first biologic and/or second biologic is a cell.

24d. The method of embodiment 23d, wherein the cell is a bacterial cell, a yeast cell, or a mammalian cell.

25d. The method of embodiment 23d or 24d, wherein the cell is a stem cell, a bone cell, a blood cell, a muscle cell, a fat cell, a skin cell, a nerve cell, an endothelial cell, a sex cell, a pancreatic cell, or a cancer cell.

26d. The method of any one of embodiments 23d or 24d, wherein the cell is an immune cell.

27d. The method of embodiment 26d, wherein the immune cell is a T cell, a B cell, a NK cell, a peripheral blood mononuclear cell, or a neutrophil.

28d. The method of embodiment 27d, wherein the cell is a T cell expressing a chimeric antigen receptor (CAR).

29d. The method of embodiment 22d, wherein the nucleic acid is a DNA or an RNA.

30d. The method of embodiment 22d, wherein the viral particle is an adenovirus particle, an adeno-associated virus (AAV) particle, a lentivirus particle, a retrovirus particle, a poxvirus particle, a measles virus particle, or a herpesvirus particle.

31d. The method of any one of embodiments 1d-30d, wherein the first biologic and/or second biologic has a diameter between 1 nm and 100 μm, inclusive of the endpoints.

32d. The method of embodiment 31d, wherein the first biologic and/or second biologic has a diameter between 1 nm and 100 nm, inclusive of the endpoints.

33d. The method of embodiment 31d, wherein the first biologic and/or second biologic has a diameter between 100 nm and 1 μm, inclusive of the endpoints.

34d. The method of embodiment 31d, wherein the first biologic and/or second biologic has a diameter between 1 μm and 50 μm, inclusive of the endpoints.

35d. The method of embodiment 31d, wherein the first biologic and/or second biologic has a diameter between 50 μm and 100 μm, inclusive of the endpoints.

36d. The method of any one of embodiments 1d-35d, wherein the method is completed in about 0.5 to about 24 hours.

37d. The method of embodiment 36d, wherein the method is completed in about 0.5 to about 8 hours.

38d. The method of embodiment 36d, wherein the method is completed in about 2 to about 6 hours.

39d. The method of any one of embodiments 1d-38d, wherein the bringing together of the first complex and the second complex can be observed visually with an unaided eye.

40d. The method of any one of embodiments 1d-39d, wherein the increase in the size of the first complex and/or second complex is at least a 2-fold increase.

41d. The method of any embodiment 40d, wherein the increase in the size of the first complex and/or second complex is at least a 10-fold increase.

42d. The method of embodiment 41d, wherein the increase in the size of the first complex and/or second complex is at least a 25-fold increase.

43d. The method of any one of embodiments 40d-42d, wherein the increase in size is an increase in the mass of the complex.

44d. The method of any one of embodiments 40d-42d, wherein the increase in size is an increase in the diameter of the complex.

45d. The method of any one of embodiments 1d-44d, wherein the environmental factor comprises one or more of:

a. a change in one or more of temperature, pH, salt concentration, concentration of the purification matrix, concentration of the biologic, or pressure;

b. the addition of one or more surfactants, molecular crowding agents, reducing agents, oxidizing agents, cofactor, vitamin, enzymes, or denaturing agents; or c. the application of electromagnetic or acoustic waves.

46d. The method of any one of embodiments 1d-45d, wherein the separation on the basis of size is performed using tangential flow filtration, membrane chromatography, analytical ultracentrifugation, high performance liquid chromatography, normal flow filtration, acoustic wave separation, centrifugation, counterflow centrifugation, and fast protein liquid chromatography.

INCORPORATION BY REFERENCE

All references, articles, publications, patents, patent publications, and patent applications cited herein are incorporated by reference in their entireties for all purposes. However, mention of any reference, article, publication, patent, patent publication, and patent application cited herein is not, and should not be taken as, an acknowledgment or any form of suggestion that it constitutes valid prior art or form part of the common general knowledge in any country in the world.

SEQUENCE LISTING (193 sequences)

SEQ ID NO: 1 - protein, 2520 aa, synthetic construct
  REGION 1..2520: note = resilin-like polypeptide
  REPEAT 1..7: note = single repeat of (GRGDSPY)n where n=20-360
  VARIANT 141..2520: note = up to 340 copies of (GRGDSPY) can be deleted
GRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPY

SEQ ID NO: 2 - protein, 2520 aa, synthetic construct
  REGION 1..2520: note = resilin-like polypeptide
  REPEAT 1..7: note = single repeat of (GRGDSPH)n where n=20-360
  VARIANT 141..2520: note = up to 340 copies of (GRGDSPH) can be deleted
GRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPH

SEQ ID NO: 3 - protein, 2520 aa, synthetic construct
  REGION 1..2520: note = resilin-like polypeptide
  REPEAT 1..7: note = single repeat of (GRGDSPV)n where n=20-360
  VARIANT 141..2520: note = up to 340 copies of (GRGDSPV) can be deleted
GRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPV

SEQ ID NO: 4 - protein, 2880 aa, synthetic construct
  REGION 1..2880: note = resilin-like polypeptide
  REPEAT 1..8: note = single repeat of (GRGDSPYG)n where n=20-360
  VARIANT 161..2880: note = up to 340 copies of (GRGDSPYG) can be deleted
GRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYG

SEQ ID NO: 5 - protein, 2520 aa, synthetic construct
  REGION 1..2520: note = resilin-like polypeptide
  REPEAT 1..7: note = single repeat of (RPLGYDS)n where n=20-360
  VARIANT 141..2520: note = up to 340 copies of (RPLGYDS) can be deleted
RPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDS

SEQ ID NO: 6 - protein, 2520 aa, synthetic construct
  REGION 1..2520: note = resilin-like polypeptide
  REPEAT 1..7: note = single repeat of (RPAGYDS)n where n=20-360
  VARIANT 141..2520: note = up to 340 copies of (RPAGYDS) can be deleted
RPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDS

SEQ ID NO: 7 - protein, 2520 aa, synthetic construct
  REGION 1..2520: note = resilin-like polypeptide
  REPEAT 1..7: note = single repeat of (GRGDSYP)n where n=20-360
  VARIANT 141..2520: note = up to 340 copies of (GRGDSYP) can be deleted
GRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYP

SEQ ID NO: 8 - protein, 2880 aa, synthetic construct
  REGION 1..2880: note = resilin-like polypeptide
  REPEAT 1..8: note = single repeat of (GRGDSPYQ)n where n=20-360
  VARIANT 161..2880: note = up to 340 copies of (GRGDSPYQ) can be deleted
GRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQ

SEQ ID NO: 9 - protein, 2880 aa, synthetic construct
  REGION 1..2880: note = resilin-like polypeptide
  REPEAT 1..8: note = single repeat of (GRGNSPYG)n where n=20-360
  VARIANT 161..2880: note = up to 340 copies of (GRGNSPYG) can be deleted
GRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYG

SEQ ID NO: 10 - protein, 1800 aa, synthetic construct
  REGION 1..1800: note = elastin-like polypeptide
  REPEAT 1..5: note = single repeat of (VPGXG)n where n=1-360
  VARIANT 6..1800: note = up to 359 copies of (VPGXG) can be deleted
  VARIANT 4: note = X can be any amino acid except proline
  VARIANT 9: note = X can be any amino acid except proline
  VARIANT 14: note = X can be any amino acid except proline
  VARIANT 19: note = X can be any amino acid except proline
  VARIANT 24: note = X can be any amino acid except proline
  VARIANT 29: note = X can be any amino acid except proline
  VARIANT 34: note = X can be any amino acid except proline
  VARIANT 39: note = X can be any amino acid except proline
  VARIANT 44: note = X can be any amino acid except proline
  VARIANT 49: note = X can be any amino acid except proline
  VARIANT 54: note = X can be any amino acid except proline
  VARIANT 59: note = X can be any amino acid except proline
  VARIANT 64: note = X can be any amino acid except proline
  VARIANT 69: note = X can be any amino acid except proline
  VARIANT 74: note = X can be any amino acid except proline
  VARIANT 79: note = X can be any amino acid except proline
  VARIANT 84: note = X can be any amino acid except proline
  VARIANT 89: note = X can be any amino acid except proline
  VARIANT 94: note = X can be any amino acid except proline
  VARIANT 99: note = X can be any amino acid except proline
  VARIANT 104: note = X can be any amino acid except proline
  VARIANT 109: note = X can be any amino acid except proline
  VARIANT 114: note = X can be any amino acid except proline
  VARIANT 119: note = X can be any amino acid except proline
  VARIANT 124: note = X can be any amino acid except proline
  VARIANT 129: note = X can be any amino acid except proline
  VARIANT 134: note = X can be any amino acid except proline
  VARIANT 139: note = X can be any amino acid except proline
  VARIANT 144: note = X can be any amino acid except proline
  VARIANT 149: note = X can be any amino acid except proline
  VARIANT 154: note = X can be any amino acid except proline
  VARIANT 159: note = X can be any amino acid except proline
  VARIANT 164: note = X can be any amino acid except proline
  VARIANT 169: note = X can be any amino acid except proline
  VARIANT 174: note = X can be any amino acid except proline
  VARIANT 179: note = X can be any amino acid except proline
  VARIANT 184: note = X can be any amino acid except proline
  VARIANT 189: note = X can be any amino acid except proline
  VARIANT 194: note = X can be any amino acid except proline
  VARIANT 199: note = X can be any amino acid except proline
  VARIANT 204: note = X can be any amino acid except proline
  VARIANT 209: note = X can be any amino acid except proline
  VARIANT 214: note = X can be any amino acid except proline
  VARIANT 219: note = X can be any amino acid except proline
  VARIANT 224: note = X can be any amino acid except proline
  VARIANT 229: note = X can be any amino acid except proline
  VARIANT 234: note = X can be any amino acid except proline
  VARIANT 239: note = X can be any amino acid except proline
  VARIANT 244: note = X can be any amino acid except proline
  VARIANT 249: note = X can be any amino acid except proline
  VARIANT 254: note = X can be any amino acid except proline
  VARIANT 259: note = X can be any amino acid except proline
  VARIANT 264: note = X can be any amino acid except proline
  VARIANT 269: note = X can be any amino acid except proline
  VARIANT 274: note = X can be any amino acid except proline
  VARIANT 279: note = X can be any amino acid except proline
  VARIANT 284: note = X can be any amino acid except proline
  VARIANT 289: note = X can be any amino acid except proline
  VARIANT 294: note = X can be any amino acid except proline
  VARIANT 299: note = X can be any amino acid except proline
  VARIANT 304: note = X can be any amino acid except proline
  VARIANT 309: note = X can be any amino acid except proline
  VARIANT 314: note = X can be any amino acid except proline
  VARIANT 319: note = X can be any amino acid except proline
  VARIANT 324: note = X can be any amino acid except proline
  VARIANT 329: note = X can be any amino acid except proline
  VARIANT 334: note = X can be any amino acid except proline
  VARIANT 339: note = X can be any amino acid except proline
  VARIANT 344: note = X can be any amino acid except proline
  VARIANT 349: note = X can be any amino acid except proline
  VARIANT 354: note = X can be any amino acid except proline
  VARIANT 359: note = X can be any amino acid except proline
  VARIANT 364: note = X can be any amino acid except proline
  VARIANT 369: note = X can be any amino acid except proline
  VARIANT 374: note = X can be any amino acid except proline
  VARIANT 379: note = X can be any amino acid except proline
  VARIANT 384: note = X can be any amino acid except proline
  VARIANT 389: note = X can be any amino acid except proline
  VARIANT 394: note = X can be any amino acid except proline
  VARIANT 399: note = X can be any amino acid except proline
  VARIANT 404: note = X can be any amino acid except proline
  VARIANT 409: note = X can be any amino acid except proline
  VARIANT 414: note = X can be any amino acid except proline
  VARIANT 419: note = X can be any amino acid except proline
  VARIANT 424: note = X can be any amino acid except proline
  VARIANT 429: note = X can be any amino acid except proline
  VARIANT 434: note = X can be any amino acid except proline
  VARIANT 439: note = X can be any amino acid except proline
  VARIANT 444: note = X can be any amino acid except proline
  VARIANT 449: note = X can be any amino acid except proline
  VARIANT 454: note = X can be any amino acid except proline
  VARIANT 459: note = X can be any amino acid except proline
  VARIANT 464: note = X can be any amino acid except proline
  VARIANT 469: note = X can be any amino acid except proline
  VARIANT 474: note = X can be any amino acid except proline
  VARIANT 479: note = X can be any amino acid except proline
  VARIANT 484: note = X can be any amino acid except proline
  VARIANT 489: note = X can be any amino acid except proline
  VARIANT 494: note = X can be any amino acid except proline
  VARIANT 499: note = X can be any amino acid except proline
  VARIANT 504: note = X can be any amino acid except proline
  VARIANT 509: note = X can be any amino acid except proline
  VARIANT 514: note = X can be any amino acid except proline
  VARIANT 519: note = X can be any amino acid except proline
  VARIANT 524: note = X can be any amino acid except proline
  VARIANT 529: note = X can be any amino acid except proline
  VARIANT 534: note = X can be any amino acid except proline
  VARIANT 539: note = X can be any amino acid except proline
  VARIANT 544: note = X can be any amino acid except proline
  VARIANT 549: note = X can be any amino acid except proline
  VARIANT 554: note = X can be any amino acid except proline
  VARIANT 559: note = X can be any amino acid except proline
  VARIANT 564: note = X can be any amino acid except proline
  VARIANT 569: note = X can be any amino acid except proline
  VARIANT 574: note = X can be any amino acid except proline
  VARIANT 579: note = X can be any amino acid except proline
  VARIANT 584: note = X can be any amino acid except proline
  VARIANT 589: note = X can be any amino acid except proline
  VARIANT 594: note = X can be any amino acid except proline
  VARIANT 599: note = X can be any amino acid except proline
  VARIANT 604: note = X can be any amino acid except proline
  VARIANT 609: note = X can be any amino acid except proline
  VARIANT 614: note = X can be any amino acid except proline
  VARIANT 619: note = X can be any amino acid except proline
  VARIANT 624: note = X can be any amino acid except proline
  VARIANT 629: note = X can be any amino acid except proline
  VARIANT 634: note = X can be any amino acid except proline
  VARIANT 639: note = X can be any amino acid except proline
  VARIANT 644: note = X can be any amino acid except proline
  VARIANT 649: note = X can be any amino acid except proline
  VARIANT 654: note = X can be any amino acid except proline
  VARIANT 659: note = X can be any amino acid except proline
  VARIANT 664: note = X can be any amino acid except proline
  VARIANT 669: note = X can be any amino acid except proline
  VARIANT 674: note = X can be any amino acid except proline
  VARIANT 679: note = X can be any amino acid except proline
  VARIANT 684: note = X can be any amino acid except proline
  VARIANT 689: note = X can be any amino acid except proline
  VARIANT 694: note = X can be any amino acid except proline
  VARIANT 699: note = X can be any amino acid except proline
  VARIANT 704: note = X can be any amino acid except proline
  VARIANT 709: note = X can be any amino acid except proline
  VARIANT 714: note = X can be any amino acid except proline
  VARIANT 719: note = X can be any amino acid except proline
  VARIANT 724: note = X can be any amino acid except proline
  VARIANT 729: note = X can be any amino acid except proline
  VARIANT 734: note = X can be any amino acid except proline
  VARIANT 739: note = X can be any amino acid except proline
  VARIANT 744: note = X can be any amino acid except proline
  VARIANT 749: note = X can be any amino acid except proline
  VARIANT 754: note = X can be any amino acid except proline
  VARIANT 759: note = X can be any amino acid except proline
  VARIANT 764: note = X can be any amino acid except proline
  VARIANT 769: note = X can be any amino acid except proline
  VARIANT 774: note = X can be any amino acid except proline
  VARIANT 779: note = X can be any amino acid except proline
  VARIANT 784: note = X can be any amino acid except proline
  VARIANT 789: note = X can be any amino acid except proline
  VARIANT 794: note = X can be any amino acid except proline
  VARIANT 799: note = X can be any amino acid except proline
  VARIANT 804: note = X can be any amino acid except proline
  VARIANT 809: note = X can be any amino acid except proline
  VARIANT 814: note = X can be any amino acid except proline
  VARIANT 819: note = X can be any amino acid except proline
  VARIANT 824: note = X can be any amino acid except proline
  VARIANT 829: note = X can be any amino acid except proline
  VARIANT 834: note = X can be any amino acid except proline
  VARIANT 839: note = X can be any amino acid except proline
  VARIANT 844: note = X can be any amino acid except proline
  VARIANT 849: note = X can be any amino acid except proline
  VARIANT 854: note = X can be any amino acid except proline
  VARIANT 859: note = X can be any amino acid except proline
  VARIANT 864: note = X can be any amino acid except proline
  VARIANT 869: note = X can be any amino acid except proline
  VARIANT 874: note = X can be any amino acid except proline
  VARIANT 879: note = X can be any amino acid except proline
  VARIANT 884: note = X can be any amino acid except proline
  VARIANT 889: note = X can be any amino acid except proline
  VARIANT 894: note = X can be any amino acid except proline
  VARIANT 899: note = X can be any amino acid except proline
  VARIANT 904: note = X can be any amino acid except proline
  VARIANT 909: note = X can be any amino acid except proline
  VARIANT 914: note = X can be any amino acid except proline
  VARIANT 919: note = X can be any amino acid except proline
  VARIANT 924: note = X can be any amino acid except proline
  VARIANT 929: note = X can be any amino acid except proline
  VARIANT 934: note = X can be any amino acid except proline
  VARIANT 939: note = X can be any amino acid except proline
  VARIANT 944: note = X can be any amino acid except proline
  VARIANT 949: note = X can be any amino acid except proline
  VARIANT 954: note = X can be any amino acid except proline
  VARIANT 959: note = X can be any amino acid except proline
  VARIANT 964: note = X can be any amino acid except proline
  VARIANT 969: note = X can be any amino acid except proline
  VARIANT 974: note = X can be any amino acid except proline
  VARIANT 979: note = X can be any amino acid except proline
  VARIANT 984: note = X can be any amino acid except proline
  VARIANT 989: note = X can be any amino acid except proline
  VARIANT 994: note = X can be any amino acid except proline
  VARIANT 999: note = X can be any amino acid except proline
  VARIANT 1004: note = X can be any amino acid except proline
  VARIANT 1009: note = X can be any amino acid except proline
  VARIANT 1014: note = X can be any amino acid except proline
  VARIANT 1019: note = X can be any amino acid except proline
  VARIANT 1024: note = X can be any amino acid except proline
  VARIANT 1029: note = X can be any amino acid except proline
  VARIANT 1034: note = X can be any amino acid except proline
  VARIANT 1039: note = X can be any amino acid except proline
  VARIANT 1044: note = X can be any amino acid except proline
  VARIANT 1049: note = X can be any amino acid except proline
  VARIANT 1054: note = X can be any amino acid except proline
  VARIANT 1059: note = X can be any amino acid except proline
  VARIANT 1064: note = X can be any amino acid except proline
  VARIANT 1069: note = X can be any amino acid except proline
  VARIANT 1074: note = X can be any amino acid except proline
  VARIANT 1079: note = X can be any amino acid except proline
  VARIANT 1084: note = X can be any amino acid except proline
  VARIANT 1089: note = X can be any amino acid except proline
  VARIANT 1094: note = X can be any amino acid except proline
  VARIANT 1099: note = X can be any amino acid except proline
  VARIANT 1104: note = X can be any amino acid except proline
  VARIANT 1109: note = X can be any amino acid except proline
  VARIANT 1114: note = X can be any amino acid except proline
  VARIANT 1119: note = X can be any amino acid except proline
  VARIANT 1124: note = X can be any amino acid except proline
  VARIANT 1129: note = X can be any amino acid except proline
  VARIANT 1134: note = X can be any amino acid except proline
  VARIANT 1139: note = X can be any amino acid except proline
  VARIANT 1144: note = X can be any amino acid except proline
  VARIANT 1149: note = X can be any amino acid except proline
  VARIANT 1154: note = X can be any amino acid except proline
  VARIANT 1159: note = X can be any amino acid except proline
  VARIANT 1164: note = X can be any amino acid except proline
  VARIANT 1169: note = X can be any amino acid except proline
  VARIANT 1174: note = X can be any amino acid except proline
  VARIANT 1179: note = X can be any amino acid except proline
  VARIANT 1184: note = X can be any amino acid except proline
  VARIANT 1189: note = X can be any amino acid except proline
  VARIANT 1194: note = X can be any amino acid except proline
  VARIANT 1199: note = X can be any amino acid except proline
  VARIANT 1204: note = X can be any amino acid except proline
  VARIANT 1209: note = X can be any amino acid except proline
  VARIANT 1214: note = X can be any amino acid except proline
  VARIANT 1219: note = X can be any amino acid except proline
  VARIANT 1224: note = X can be any amino acid except proline
  VARIANT 1229: note = X can be any amino acid except proline
  VARIANT 1234: note = X can be any amino acid except proline
  VARIANT 1239: note = X can be any amino acid except proline
  VARIANT 1244: note = X can be any amino acid except proline
  VARIANT 1249: note = X can be any amino acid except proline
  VARIANT 1254: note = X can be any amino acid except proline
  VARIANT 1259: note = X can be any amino acid except proline
  VARIANT 1264: note = X can be any amino acid except proline
  VARIANT 1269: note = X can be any amino acid except proline
  VARIANT 1274: note = X can be any amino acid except proline
  VARIANT 1279: note = X can be any amino acid except proline
  VARIANT 1284: note = X can be any amino acid except proline
  VARIANT 1289: note = X can be any amino acid except proline
  VARIANT 1294: note = X can be any amino acid except proline
  VARIANT 1299: note = X can be any amino acid except proline
  VARIANT 1304: note = X can be any amino acid except proline
  VARIANT 1309: note = X can be any amino acid except proline
  VARIANT 1314: note = X can be any amino acid except proline
  VARIANT 1319: note = X can be any amino acid except proline
  VARIANT 1324: note = X can be any amino acid except proline
  VARIANT 1329: note = X can be any amino acid except proline
  VARIANT 1334: note = X can be any amino acid except proline
  VARIANT 1339: note = X can be any amino acid except proline
  VARIANT 1344: note = X can be any amino acid except proline
  VARIANT 1349: note = X can be any amino acid except proline
  VARIANT 1354: note = X can be any amino acid except proline
  VARIANT 1359: note = X can be any amino acid except proline
  VARIANT 1364: note = X can be any amino acid except proline
  VARIANT 1369: note = X can be any amino acid except proline
  VARIANT 1374: note = X can be any amino acid except proline
  VARIANT 1379: note = X can be any amino acid except proline
  VARIANT 1384: note = X can be any amino acid except proline
  VARIANT 1389: note = X can be any amino acid except proline
  VARIANT 1394: note = X can be any amino acid except proline
  VARIANT 1399: note = X can be any amino acid except proline
  VARIANT 1404: note = X can be any amino acid except proline
  VARIANT 1409: note = X can be any amino acid except proline
  VARIANT 1414: note = X can be any amino acid except proline
  VARIANT 1419: note = X can be any amino acid except proline
  VARIANT 1424: note = X can be any amino acid except proline
  VARIANT 1429: note = X can be any amino acid except proline
  VARIANT 1434: note = X can be any amino acid except proline
  VARIANT 1439: note = X can be any amino acid except proline
  VARIANT 1444: note = X can be any amino acid except proline
  VARIANT 1449: note = X can be any amino acid except proline
  VARIANT 1454: note = X can be any amino acid except proline
  VARIANT 1459: note = X can be any amino acid except proline
  VARIANT 1464: note = X can be any amino acid except proline
  VARIANT 1469: note = X can be any amino acid except proline
  VARIANT 1474: note = X can be any amino acid except proline
  VARIANT 1479: note = X can be any amino acid except proline
  VARIANT 1484: note = X can be any amino acid except proline
  VARIANT 1489: note = X can be any amino acid except proline
  VARIANT 1494: note = X can be any amino acid except proline
  VARIANT 1499: note = X can be any amino acid except proline
  VARIANT 1504: note = X can be any amino acid except proline
  VARIANT 1509: note = X can be any amino acid except proline
  VARIANT 1514: note = X can be any amino acid except proline
  VARIANT 1519: note = X can be any amino acid except proline
  VARIANT 1524: note = X can be any amino acid except proline
  VARIANT 1529: note = X can be any amino acid except proline
  VARIANT 1534: note = X can be any amino acid except proline
  VARIANT 1539: note = X can be any amino acid except proline
  VARIANT 1544: note = X can be any amino acid except proline
  VARIANT 1549: note = X can be any amino acid except proline
  VARIANT 1554: note = X can be any amino acid except proline
  VARIANT 1559: note = X can be any amino acid except proline
  VARIANT 1564: note = X can be any amino acid except proline
  VARIANT 1569: note = X can be any amino acid except proline
  VARIANT 1574: note = X can be any amino acid except proline
  VARIANT 1579: note = X can be any amino acid except proline
  VARIANT 1584: note = X can be any amino acid except proline
  VARIANT 1589: note = X can be any amino acid except proline
  VARIANT 1594: note = X can be any amino acid except proline
  VARIANT 1599: note = X can be any amino acid except proline
  VARIANT 1604: note = X can be any amino acid except proline
  VARIANT 1609: note = X can be any amino acid except proline
  VARIANT 1614: note = X can be any amino acid except proline
  VARIANT 1619: note = X can be any amino acid except proline
  VARIANT 1624: note = X can be any amino acid except proline
  VARIANT 1629: note = X can be any amino acid except proline
  VARIANT 1634: note = X can be any amino acid except proline
  VARIANT 1639: note = X can be any amino acid except proline
  VARIANT 1644: note = X can be any amino acid except proline
  VARIANT 1649: note = X can be any amino acid except proline
  VARIANT 1654: note = X can be any amino acid except proline
  VARIANT 1659: note = X can be any amino acid except proline
  VARIANT 1664: note = X can be any amino acid except proline
  VARIANT 1669: note = X can be any amino acid except proline
  VARIANT 1674: note = X can be any amino acid except proline
  VARIANT 1679: note = X can be any amino acid except proline
  VARIANT 1684: note = X can be any amino acid except proline
  VARIANT 1689: note = X can be any amino acid except proline
  VARIANT 1694: note = X can be any amino acid except proline
  VARIANT 1699: note = X can be any amino acid except proline
  VARIANT 1704: note = X can be any amino acid except proline
  VARIANT 1709: note = X can be any amino acid except proline
  VARIANT 1714: note = X can be any amino acid except proline
  VARIANT 1719: note = X can be any amino acid except proline
  VARIANT 1724: note = X can be any amino acid except proline
  VARIANT 1729: note = X can be any amino acid except proline
  VARIANT 1734: note = X can be any amino acid except proline
  VARIANT 1739: note = X can be any amino acid except proline
  VARIANT 1744: note = X can be any amino acid except proline
  VARIANT 1749: note = X can be any amino acid except proline
  VARIANT 1754: note = X can be any amino acid except proline
  VARIANT 1759: note = X can be any amino acid except proline
  VARIANT 1764: note = X can be any amino acid except proline
  VARIANT 1769: note = X can be any amino acid except proline
  VARIANT 1774: note = X can be any amino acid except proline
  VARIANT 1779: note = X can be any amino acid except proline
  VARIANT 1784: note = X can be any amino acid except proline
  VARIANT 1789: note = X can be any amino acid except proline
  VARIANT 1794: note = X can be any amino acid except proline
  VARIANT 1799: note = X can be any amino acid except proline
VPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXG

SEQ ID NO: 11 - protein, 1800 aa, synthetic construct
  REGION 1..1800: note = elastin-like polypeptide
  REPEAT 1..5: note = single repeat of (GVGVP)n where n=20-360
  VARIANT 101..1800: note = up to 340 copies of (GVGVP) can be deleted
GVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVP

SEQ ID NO: 12 - protein, 625 aa, synthetic construct
  REGION 1..625: note = elastin-like polypeptide
  REPEAT 1..25: note = single repeat of (GVGVPGLGVPGVGVPGLGVPGVGVP)m where; m = 4-25
  VARIANT 101..625: note = up to 21 copies of (GVGVPGLGVPGVGVPGLGVPGVGVP) can be deleted
GVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVP

SEQ ID NO: 13 - protein, 625 aa, synthetic construct
  REGION 1..625: note = elastin-like polypeptide
  REPEAT 1..25: note = single repeat of (GVGVPGVGVPGAGVPGVGVPGVGVP)m where; m = 4-25
  VARIANT 101..625: note = up to 21 copies of (GVGVPGVGVPGAGVPGVGVPGVGVP) can be deleted
GVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVP

SEQ ID NO: 14 - protein, 625 aa, synthetic construct
  REGION 1..625: note = elastin-like polypeptide
  REPEAT 1..25: note = single repeat of (GVGVPGWGVPGVGVPGWGVPGVGVP)m where; m = 4-25
  VARIANT 101..625: note = up to 21 copies of (GVGVPGWGVPGVGVPGWGVPGVGVP) can be deleted
GVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVP

SEQ ID NO: 15 - protein, 1125 aa, synthetic construct
  REGION 1..1125: note = elastin-like polypeptide
  REPEAT 1..45: note = single repeat of (GVGVPGVGVPGVGVPGVGVPGVGVPGVGVPGEGVPGFGVPGVGVP)m where; m = 4-25
  VARIANT 181..1125: note = up to 21 copies of (GVGVPGVGVPGVGVPGVGVPGVGVPGVGVPGEGVPGFGVPGVGVP) can be deleted
GVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVP

SEQ ID NO: 16 - protein, 1125 aa, synthetic construct
  REGION 1..1125: note = elastin-like polypeptide
  REPEAT 1..45: note = single repeat of (GVGVPGVGVPGVGVPGVGVPGVGVPGVGVPGKGVPGFGVPGVGVP)m where; m = 4-25
  VARIANT 181..1125: note = up to 21 copies of (GVGVPGVGVPGVGVPGVGVPGVGVPGVGVPGKGVPGFGVPGVGVP) can be deleted
GVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVP

SEQ ID NO: 17 - protein, 625 aa, synthetic construct
  REGION 1..625: note = elastin-like polypeptide
  REPEAT 1..25: note = single repeat of (GAGVPGVGVPGAGVPGVGVPGAGVP)m where; m = 4-25
  VARIANT 101..625: note = up to 21 copies of (GAGVPGVGVPGAGVPGVGVPGAGVP) can be deleted
GAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVP

SEQ ID NO: 18 - protein, 100 aa, synthetic construct
  REGION 1..100: note = Linker peptide
  REPEAT 1..5: note = single repeat of (EAAAK)n where n=1-20
  VARIANT 6..100: note = up to 19 copies of (EAAAK) can be deleted
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 19 - protein, 150 aa, synthetic construct
  REGION 1..150: note = Linker peptide
  REPEAT 1..5: note = single repeat of (GGGGS)n where n=1-30
  VARIANT 6..150: note = up to 29 copies of (GGGGS) can be deleted
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 20 - protein, 200 aa, synthetic construct
  REGION 1..200: note = Linker peptide
  REPEAT 1..4: note = single repeat of (SGGG)n where n=1-50
  VARIANT 5..200: note = up to 49 copies of (SGGG) can be deleted
SGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGG

SEQ ID NO: 21 - protein, 80 aa, synthetic construct
  REGION 1..80: note = Linker peptide
  REPEAT 1..4: note = single repeat of (GGGS)n where n=1-20
  VARIANT 5..80: note = up to 19 copies of (SGGG) can be deleted
GGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 22 - protein, 18 aa, synthetic construct
  REGION 1..18: note = Linker peptide
KESGSVSSEQLAQFRSLD

SEQ ID NO: 23 - protein, 14 aa, synthetic construct
  REGION 1..14: note = Linker peptide
EGKSSGSGSESKST

SEQ ID NO: 24 - protein, 58 aa, synthetic construct [sequence omitted]

SEQ ID NO: 25 - protein, 59 aa, synthetic construct
  REGION 1..59: note = Capture domain
VDNKFNKEQQNAFYEILSLPNLNEEQRAAFIQSLKDDPSQSANLLAEAKKLNDAQAPKG

SEQ ID NO: 26 - protein, 59 aa, synthetic construct
  REGION 1..59: note = Capture domain
VDNKFNKEHQNAFYEILHLPNLNEEQRNAFIQSLKHDPSQSANLLAEAKKLNDAQAPKG

SEQ ID NO: 27 - protein, 254 aa, synthetic construct
  REGION 1..254: note = Capture domain
AQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPN

SEQ ID NO: 28 - protein, 56 aa, synthetic construct
  REGION 1..56: note = Capture domain
TYKLILNGKTLKGETTTEAVDAATAEKVFKQYANDNGVDGEWTYDDATKTFTVTEG

SEQ ID NO: 29 - protein, 189 aa, synthetic construct
  REGION 1..189: note = Capture domain
KTDTYKLILNGKTLKGETTTEAVDAATAEKVFKQYANDNGVDGEWTYDDATKTFTVTEKPEVIDASELTPAVTTYKLVINGKTLKGETTTKAVDAETAEKAFKQYANDNGVDGVWTYDDATKTFTVTEMVTEVPGDAPTEPEKPEASIPLVPLTPATPIAKDDAKKDDTKKEDAKKPEAKKDDAKKAET

SEQ ID NO: 30 - protein, 76 aa, synthetic construct
  REGION 1..76: note = Capture domain
KEETPETPETDSEEEVTIKANLIFANGSTQTAEFKGTFEKATSEAYAYADTLKKDNGEYTVDVADKGYTLNLKFAG

SEQ ID NO: 31 - protein, 7 aa, synthetic construct
  REGION 1..7: note = Capture domain
  VARIANT 5: note = R, H or K
  VARIANT 6: note = R or H
  VARIANT 7: note = P or S
GYVSXXX

SEQ ID NO: 32 - protein, 226 aa, synthetic construct
  REGION 1..226: note = Capture domain
SDVQLQESGPDLVKPSQSLSLTCTVTGYSITSGYTWHWIRQFPGNKQEWGYIHFSGYTNYNPSLKSRVSITRDTSKNQFFLHLNSVTTEDTATYYCARGDYGYEWFTYWGQGTLVTVSADIQMTQSSSSFSVSLGDRVTITCKASEDIHNRLAWYKQKPGNAPRLLISGATSLETGVPSRFSGSGSGKDYTLSITSLQNEDVATYYCQQYWIGPFTFGSGTNLEIK

SEQ ID NO: 33 - protein, 11 aa, synthetic construct
  REGION 1..11: note = Capture domain
GYVSRHPGGGC

SEQ ID NO: 34 - protein, 12 aa, synthetic construct
  REGION 1..12: note = Capture domain
GYVSRHPGGGGS

SEQ ID NO: 35 - protein, 11 aa, synthetic construct
  REGION 1..11: note = Capture domain
FHENWPSGGGC

SEQ ID NO: 36 - protein, 12 aa, synthetic construct
  REGION 1..12: note = Capture domain
FHENWPSGGGGS

SEQ ID NO: 37 - protein, 7 aa, synthetic construct
  REGION 1..7: note = Capture domain
GVVTINP

SEQ ID NO: 38 - protein, 7 aa, synthetic construct
  REGION 1..7: note = Capture domain
GLVTPSG

SEQ ID NO: 39 - protein, 7 aa, synthetic construct
  REGION 1..7: note = Capture domain
GYVSHRS

SEQ ID NO: 40 - protein, 7 aa, synthetic construct
  REGION 1..7: note = Capture domain
KVWILTP

SEQ ID NO: 41 - protein, 7 aa, synthetic construct
  REGION 1..7: note = Capture domain
KLWVIPQ

SEQ ID NO: 42 - protein, 479 aa, synthetic construct
  REGION 1..479: note = Capture domain
GVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRG

SEQ ID NO: 43 - protein, 90 aa, synthetic construct
  REGION 1..90: note = Capture domain
SAGESVQITLPKNEVQLNAYVLQEPPKGETYTYDWQLITHPRDYSGEMEGKHSQILKLSKLTPGLYEFKVIVEGQNAHGEGYVNVTVKPE

SEQ ID NO: 44 - protein, 90 aa, synthetic construct
  REGION 1..90: note = Capture domain
IAIVSPQFQEISLPTTSTVIDGSQSTDDDKIVQYHWEELKGPLREEKISEDTAILKLSKLVPGNYTFSLTVVDSDGATNSTTANLTVNKA

SEQ ID NO: 45 - protein, 190 aa, synthetic construct
  REGION 1..190: note = Capture domain
MGVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKA

SEQ ID NO: 46 - protein, 91 aa, synthetic construct
  REGION 1..91: note = Capture domain
VANAGPNQVITLPQNSITLFGNQSTDDHGITSYEWSLSPSSKGKVVEMQGVRTPTLQLSAMQEGDYTYQLTVTDTIGQQATAQVTVIVQPE

SEQ ID NO: 47 - protein, 89 aa, synthetic construct
  REGION 1..89: note = Capture domain
QADAGPDKELTLPVDSTTLDGSKSSDDQKIISYLWEKTQGPDGVQLENANSSVATVTGLQVGTYVFTLTVKDERNLQSQSSVNVIVKEE

SEQ ID NO: 48 - protein, 93 aa, synthetic construct
  REGION 1..93: note = Capture domain
IAKITGNVVITLPTSTAELDGSKSSDDKGIVSYLWTRDEGSPAAGEVLNHSDHHPILFLSNLVEGTYTFHLKVTDAKGESDTDRTTVEVKPDP

SEQ ID NO: 49 - protein, 46 aa, synthetic construct
  REGION 1..46: note = Capture domain
LAEAKVLANRELDKYGVSDYYKNLINNAKTVEGVKALIDEILAALP

SEQ ID NO: 50 - protein, 30 aa, synthetic construct
  REGION 1..30: note = Linker peptide
  REPEAT 1: note = single repeat of (G)n where n=1-30
  VARIANT 2..30: note = up to 29 copies of (G) can be deleted
GGGGGGGGGGGGGGGGGGGGGGGGGGGGGG

SEQ ID NO: 51 - protein, 1280 aa, synthetic construct
  REGION 1..1280: note = elastin-like polypeptide
  REPEAT 1..8: note = single repeat of (XXPXDGRG)n where n=1-20
  VARIANT 81..1280: note = up to 150 copies of (XXPXDGRG) can be deleted
  VARIANT 1: note = Q or S
  VARIANT 2: note = Y or V
  VARIANT 4: note = Q or S
  VARIANT 9: note = Q or S
  VARIANT 10: note = Y or V
  VARIANT 12: note = Q or S
  VARIANT 17: note = Q or S
  VARIANT 18: note = Y or V
  VARIANT 20: note = Q or S
  VARIANT 25: note = Q or S
  VARIANT 26: note = Y or V
  VARIANT 28: note = Q or S
  VARIANT 33: note = Q or S
  VARIANT 34: note = Y or V
  VARIANT 36: note = Q or S
  VARIANT 41: note = Q or S
  VARIANT 42: note = Y or V
  VARIANT 44: note = Q or S
  VARIANT 49: note = Q or S
  VARIANT 50: note = Y or V
  VARIANT 52: note = Q or S
  VARIANT 57: note = Q or S
  VARIANT 58: note = Y or V
  VARIANT 60: note = Q or S
  VARIANT 65: note = Q or S
  VARIANT 66: note = Y or V
  VARIANT 68: note = Q or S
  VARIANT 73: note = Q or S
  VARIANT 74: note = Y or V
  VARIANT 76: note = Q or S
  VARIANT 81: note = Q or S
  VARIANT 82: note = Y or V
  VARIANT 84: note = Q or S
  VARIANT 89: note = Q or S
  VARIANT 90: note = Y or V
  VARIANT 92: note = Q or S
  VARIANT 97: note = Q or S
  VARIANT 98: note = Y or V
  VARIANT 100: note = Q or S
  VARIANT 105: note = Q or S
  VARIANT 106: note = Y or V
  VARIANT 108: note = Q or S
  VARIANT 113: note = Q or S
  VARIANT 114: note = Y or V
  VARIANT 116: note = Q or S
  VARIANT 121: note = Q or S
  VARIANT 122: note = Y or V
  VARIANT 124: note = Q or S
  VARIANT 129: note = Q or S
  VARIANT 130: note = Y or V
  VARIANT 132: note = Q or S
  VARIANT 137: note = Q or S
  VARIANT 138: note = Y or V
  VARIANT 140: note = Q or S
  VARIANT 145: note = Q or S
  VARIANT 146: note = Y or V
  VARIANT 148: note = Q or S
  VARIANT 153: note = Q or S
  VARIANT 154: note = Y or V
  VARIANT 156: note = Q or S
  VARIANT 161: note = Q or S
  VARIANT 162: note = Y or V
  VARIANT 164: note = Q or S
  VARIANT 169: note = Q or S
  VARIANT 170: note = Y or V
  VARIANT 172: note = Q or S
  VARIANT 177: note = Q or S
  VARIANT 178: note = Y or V
  VARIANT 180: note = Q or S
  VARIANT 185: note = Q or S
  VARIANT 186: note = Y or V
  VARIANT 188: note = Q or S
  VARIANT 193: note = Q or S
  VARIANT 194: note = Y or V
  VARIANT 196: note = Q or S
  VARIANT 201: note = Q or S
  VARIANT 202: note = Y or V
  VARIANT 204: note = Q or S
  VARIANT 209: note = Q or S
  VARIANT 210: note = Y or V
  VARIANT 212: note = Q or S
  VARIANT 217: note = Q or S
  VARIANT 218: note = Y or V
  VARIANT 220: note = Q or S
  VARIANT 225: note = Q or S
  VARIANT 226: note = Y or V
  VARIANT 228: note = Q or S
  VARIANT 233: note = Q or S
  VARIANT 234: note = Y or V
  VARIANT 236: note = Q or S
  VARIANT 241: note = Q or S
  VARIANT 242: note = Y or V
  VARIANT 244: note = Q or S
  VARIANT 249: note = Q or S
  VARIANT 250: note = Y or V
  VARIANT 252: note = Q or S
  VARIANT 257: note = Q or S
  VARIANT 258: note = Y or V
  VARIANT 260: note = Q or S
  VARIANT 265: note = Q or S
  VARIANT 266: note = Y or V
  VARIANT 268: note = Q or S
  VARIANT 273: note = Q or S
  VARIANT 274: note = Y or V
  VARIANT 276: note = Q or S
  VARIANT 281: note = Q or S
  VARIANT 282: note = Y or V
  VARIANT 284: note = Q or S
  VARIANT 289: note = Q or S
  VARIANT 290: note = Y or V
  VARIANT 292: note = Q or S
  VARIANT 297: note = Q or S
  VARIANT 298: note = Y or V
  VARIANT 300: note = Q or S
  VARIANT 305: note = Q or S
  VARIANT 306: note = Y or V
  VARIANT 308: note = Q or S
  VARIANT 313: note = Q or S
  VARIANT 314: note = Y or V
  VARIANT 316: note = Q or S
  VARIANT 321: note = Q or S
  VARIANT 322: note = Y or V
  VARIANT 324: note = Q or S
  VARIANT 329: note = Q or S
  VARIANT 330: note = Y or V
  VARIANT 332: note = Q or S
  VARIANT 337: note = Q or S
  VARIANT 338: note = Y or V
  VARIANT 340: note = Q or S
  VARIANT 345: note = Q or S
  VARIANT 346: note = Y or V
  VARIANT 348: note = Q or S
  VARIANT 353: note = Q or S
  VARIANT 354: note = Y or V
  VARIANT 356: note = Q or S
  VARIANT 361: note = Q or S
  VARIANT 362: note = Y or V
  VARIANT 364: note = Q or S
  VARIANT 369: note = Q or S
  VARIANT 370: note = Y or V
  VARIANT 372: note = Q or S
  VARIANT 377: note = Q or S
  VARIANT 378: note = Y or V
  VARIANT 380: note = Q or S
  VARIANT 385: note = Q or S
  VARIANT 386: note = Y or V
  VARIANT 388: note = Q or S
  VARIANT 393: note = Q or S
  VARIANT 394: note = Y or V
  VARIANT 396: note = Q or S
  VARIANT 401: note = Q or S
  VARIANT 402: note = Y or V
  VARIANT 404: note = Q or S
  VARIANT 409: note = Q or S
  VARIANT 410: note = Y or V
  VARIANT 412: note = Q or S
  VARIANT 417: note = Q or S
  VARIANT 418: note = Y or V
  VARIANT 420: note = Q or S
  VARIANT 425: note = Q or S
  VARIANT 426: note = Y or V
  VARIANT 428: note = Q or S
  VARIANT 433: note = Q or S
  VARIANT 434: note = Y or V
  VARIANT 436: note = Q or S
  VARIANT 441: note = Q or S
  VARIANT 442: note = Y or V
  VARIANT 444: note = Q or S
  VARIANT 449: note = Q or S
  VARIANT 450: note = Y or V
  VARIANT 452: note = Q or S
  VARIANT 457: note = Q or S
  VARIANT 458: note = Y or V
  VARIANT 460: note = Q or S
  VARIANT 465: note = Q or S
  VARIANT 466: note = Y or V
  VARIANT 468: note = Q or S
  VARIANT 473: note = Q or S
  VARIANT 474: note = Y or V
  VARIANT 476: note = Q or S
  VARIANT 481: note = Q or S
  VARIANT 482: note = Y or V
  VARIANT 484: note = Q or S
  VARIANT 489: note = Q or S
  VARIANT 490: note = Y or V
  VARIANT 492: note = Q or S
  VARIANT 497: note = Q or S
  VARIANT 498: note = Y or V
  VARIANT 500: note = Q or S
  VARIANT 505: note = Q or S
  VARIANT 506: note = Y or V
  VARIANT 508: note = Q or S
  VARIANT 513: note = Q or S
  VARIANT 514: note = Y or V
  VARIANT 516: note = Q or S
  VARIANT 521: note = Q or S
  VARIANT 522: note = Y or V
  VARIANT 524: note = Q or S
  VARIANT 529: note = Q or S
  VARIANT 530: note = Y or V
  VARIANT 532: note = Q or S
  VARIANT 537: note = Q or S
  VARIANT 538: note = Y or V
  VARIANT 540: note = Q or S
  VARIANT 545: note = Q or S
  VARIANT 546: note = Y or V
  VARIANT 548: note = Q or S
  VARIANT 553: note = Q or S
  VARIANT 554: note = Y or V
  VARIANT 556: note = Q or S
  VARIANT 561: note = Q or S
  VARIANT 562: note = Y or V
  VARIANT 564: note = Q or S
  VARIANT 569: note = Q or S
  VARIANT 570: note = Y or V
  VARIANT 572: note = Q or S
  VARIANT 577: note = Q or S
  VARIANT 578: note = Y or V
  VARIANT 580: note = Q or S
  VARIANT 585: note = Q or S
  VARIANT 586: note = Y or V
  VARIANT 588: note = Q or S
  VARIANT 593: note = Q or S
  VARIANT 594: note = Y or V
  VARIANT 596: note = Q or S
  VARIANT 601: note = Q or S
  VARIANT 602: note = Y or V
  VARIANT 604: note = Q or S
  VARIANT 609: note = Q or S
  VARIANT 610: note = Y or V
  VARIANT 612: note = Q or S
  VARIANT 617: note = Q or S
  VARIANT 618: note = Y or V
  VARIANT 620: note = Q or S
  VARIANT 625: note = Q or S
  VARIANT 626: note = Y or V
  VARIANT 628: note = Q or S
  VARIANT 633: note = Q or S
  VARIANT 634: note = Y or V
  VARIANT 636: note = Q or S
  VARIANT 641: note = Q or S
  VARIANT 642: note = Y or V
  VARIANT 644: note = Q or S
  VARIANT 649: note = Q or S
  VARIANT 650: note = Y or V
  VARIANT 652: note = Q or S
  VARIANT 657: note = Q or S
  VARIANT 658: note = Y or V
  VARIANT 660: note = Q or S
  VARIANT 665: note = Q or S
  VARIANT 666: note = Y or V
  VARIANT 668: note = Q or S
  VARIANT 673: note = Q or S
  VARIANT 674: note = Y or V
  VARIANT 676: note = Q or S
  VARIANT 681: note = Q or S
  VARIANT 682: note = Y or V
  VARIANT 684: note = Q or S
  VARIANT 689: note = Q or S
  VARIANT 690: note = Y or V
  VARIANT 692: note = Q or S
  VARIANT 697: note = Q or S
  VARIANT 698: note = Y or V
  VARIANT 700: note = Q or S
  VARIANT 705: note = Q or S
  VARIANT 706: note = Y or V
  VARIANT 708: note = Q or S
  VARIANT 713: note = Q or S
  VARIANT 714: note = Y or V
  VARIANT 716: note = Q or S
  VARIANT 721: note = Q or S
  VARIANT 722: note = Y or V
  VARIANT 724: note = Q or S
  VARIANT 729: note = Q or S
  VARIANT 730: note = Y or V
  VARIANT 732: note = Q or S
  VARIANT 737: note = Q or S
  VARIANT 738: note = Y or V
  VARIANT 740: note = Q or S
  VARIANT 745: note = Q or S
  VARIANT 746: note = Y or V
  VARIANT 748: note = Q or S
  VARIANT 753: note = Q or S
  VARIANT 754: note = Y or V
  VARIANT 756: note = Q or S
  VARIANT 761: note = Q or S
  VARIANT 762: note = Y or V
  VARIANT 764: note = Q or S
  VARIANT 769: note = Q or S
  VARIANT 770: note = Y or V
  VARIANT 772: note = Q or S
  VARIANT 777: note = Q or S
  VARIANT 778: note = Y or V
  VARIANT 780: note = Q or S
  VARIANT 785: note = Q or S
  VARIANT 786: note = Y or V
  VARIANT 788: note = Q or S
  VARIANT 793: note = Q or S
  VARIANT 794: note = Y or V
  VARIANT 796: note = Q or S
  VARIANT 801: note = Q or S
  VARIANT 802: note = Y or V
  VARIANT 804: note = Q or S
  VARIANT 809: note = Q or S
  VARIANT 810: note = Y or V
  VARIANT 812: note = Q or S
  VARIANT 817: note = Q or S
  VARIANT 818: note = Y or V
  VARIANT 820: note = Q or S
  VARIANT 825: note = Q or S
  VARIANT 826: note = Y or V
  VARIANT 828: note = Q or S
  VARIANT 833: note = Q or S
  VARIANT 834: note = Y or V
  VARIANT 836: note = Q or S
  VARIANT 841: note = Q or S
  VARIANT 842: note = Y or V
  VARIANT 844: note = Q or S
  VARIANT 849: note = Q or S
  VARIANT 850: note = Y or V
  VARIANT 852: note = Q or S
  VARIANT 857: note = Q or S
  VARIANT 858: note = Y or V
  VARIANT 860: note = Q or S
  VARIANT 865: note = Q or S
  VARIANT 866: note = Y or V
  VARIANT 868: note = Q or S
  VARIANT 873: note = Q or S
  VARIANT 874: note = Y or V
  VARIANT 876: note = Q or S
  VARIANT 881: note = Q or S
  VARIANT 882: note = Y or V
  VARIANT 884: note = Q or S
  VARIANT 889: note = Q or S
  VARIANT 890: note = Y or V
  VARIANT 892: note = Q or S
  VARIANT 897: note = Q or S
  VARIANT 898: note = Y or V
  VARIANT 900: note = Q or S
  VARIANT 905: note = Q or S
  VARIANT 906: note = Y or V
  VARIANT 908: note = Q or S
  VARIANT 913: note = Q or S
  VARIANT 914: note = Y or V
  VARIANT 916: note = Q or S
  VARIANT 921: note = Q or S
  VARIANT 922: note = Y or V
  VARIANT 924: note = Q or S
  VARIANT 929: note = Q or S
  VARIANT 930: note = Y or V
  VARIANT 932: note = Q or S
  VARIANT 937: note = Q or S
  VARIANT 938: note = Y or V
  VARIANT 940: note = Q or S
  VARIANT 945: note = Q or S
  VARIANT 946: note = Y or V
  VARIANT 948: note = Q or S
  VARIANT 953: note = Q or S
  VARIANT 954: note = Y or V
  VARIANT 956: note = Q or S
  VARIANT 961: note = Q or S
  VARIANT 962: note = Y or V
  VARIANT 964: note = Q or S
  VARIANT 969: note = Q or S
  VARIANT 970: note = Y or V
  VARIANT 972: note = Q or S
  VARIANT 977: note = Q or S
  VARIANT 978: note = Y or V
  VARIANT 980: note = Q or S
  VARIANT 985: note = Q or S
  VARIANT 986: note = Y or V
  VARIANT 988: note = Q or S
  VARIANT 993: note = Q or S
  VARIANT 994: note = Y or V
  VARIANT 996: note = Q or S
  VARIANT 1001: note = Q or S
  VARIANT 1002: note = Y or V
  VARIANT 1004: note = Q or S
  VARIANT 1009: note = Q or S
  VARIANT 1010: note = Y or V
  VARIANT 1012: note = Q or S
  VARIANT 1017: note = Q or S
  VARIANT 1018: note = Y or V
  VARIANT 1020: note = Q or S
  VARIANT 1025: note = Q or S
  VARIANT 1026: note = Y or V
  VARIANT 1028: note = Q or S
  VARIANT 1033: note = Q or S
  VARIANT 1034: note = Y or V
  VARIANT 1036: note = Q or S
  VARIANT 1041: note = Q or S
  VARIANT 1042: note = Y or V
  VARIANT 1044: note = Q or S
  VARIANT 1049: note = Q or S
  VARIANT 1050: note = Y or V
  VARIANT 1052: note = Q or S
  VARIANT 1057: note = Q or S
  VARIANT 1058: note = Y or V
  VARIANT 1060: note = Q or S
  VARIANT 1065: note = Q or S
  VARIANT 1066: note = Y or V
  VARIANT 1068: note = Q or S
  VARIANT 1073: note = Q or S
  VARIANT 1074: note = Y or V
  VARIANT 1076: note = Q or S
  VARIANT 1081: note = Q or S
  VARIANT 1082: note = Y or V
  VARIANT 1084: note = Q or S
  VARIANT 1089: note = Q or S
  VARIANT 1090: note = Y or V
  VARIANT 1092: note = Q or S
  VARIANT 1097: note = Q or S
  VARIANT 1098: note = Y or V
  VARIANT 1100: note = Q or S
  VARIANT 1105: note = Q or S
  VARIANT 1106: note = Y or V
  VARIANT 1108: note = Q or S
  VARIANT 1113: note = Q or S
  VARIANT 1114: note = Y or V
  VARIANT 1116: note = Q or S
  VARIANT 1121: note = Q or S
  VARIANT 1122: note = Y or V
  VARIANT 1124: note = Q or S
  VARIANT 1129: note = Q or S
  VARIANT 1130: note = Y or V
  VARIANT 1132: note = Q or S
  VARIANT 1137: note = Q or S
  VARIANT 1138: note = Y or V
  VARIANT 1140: note = Q or S
  VARIANT 1145: note = Q or S
  VARIANT 1146: note = Y or V
  VARIANT 1148: note = Q or S
  VARIANT 1153: note = Q or S
  VARIANT 1154: note = Y or V
  VARIANT 1156: note = Q or S
  VARIANT 1161: note = Q or S
  VARIANT 1162: note = Y or V
  VARIANT 1164: note = Q or S
  VARIANT 1169: note = Q or S
  VARIANT 1170: note = Y or V
  VARIANT 1172: note = Q or S
  VARIANT 1177: note = Q or S
  VARIANT 1178: note = Y or V
  VARIANT 1180: note = Q or S
  VARIANT 1185: note = Q or S
  VARIANT 1186: note = Y or V
  VARIANT 1188: note = Q or S
  VARIANT 1193: note = Q or S
  VARIANT 1194: note = Y or V
  VARIANT 1196: note = Q or S
  VARIANT 1201: note = Q or S
  VARIANT 1202: note = Y or V
  VARIANT 1204: note = Q or S
  VARIANT 1209: note = Q or S
  VARIANT 1210: note = Y or V
  VARIANT 1212: note = Q or S
  VARIANT 1217: note = Q or S
  VARIANT 1218: note = Y or V
  VARIANT 1220: note = Q or S
  VARIANT 1225: note = Q or S
  VARIANT 1226: note = Y or V
  VARIANT 1228: note = Q or S
  VARIANT 1233: note = Q or S
  VARIANT 1234: note = Y or V
  VARIANT 1236: note = Q or S
  VARIANT 1241: note = Q or S
  VARIANT 1242: note = Y or V
  VARIANT 1244: note = Q or S
  VARIANT 1249: note = Q or S
  VARIANT 1250: note = Y or V
  VARIANT 1252: note = Q or S
  VARIANT 1257: note = Q or S
  VARIANT 1258: note = Y or V
  VARIANT 1260: note = Q or S
  VARIANT 1265: note = Q or S
  VARIANT 1266: note = Y or V
  VARIANT 1268: note = Q or S
  VARIANT 1273: note = Q or S
  VARIANT 1274: note = Y or V
  VARIANT 1276: note = Q or S
XXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRG

SEQ ID NO: 52 - protein, 800 aa, synthetic construct
  REGION 1..800: note = elastin-like polypeptide
  REPEAT 1..5: note = single repeat of (GVGVP)m where m=10-160
  VARIANT 51..800: note = up to 150 copies of (GVGVP) can be deleted
GVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVP

SEQ ID NO: 53 - protein, 800 aa, synthetic construct
  REGION 1..800: note = elastin-like polypeptide
  REPEAT 1..25: note = single repeat of (GVGVPGVGVPGAGVPGVGVPGVGVP)m where; m = 2-32
  VARIANT 51..800: note = up to 30 copies of (GVGVPGVGVPGAGVPGVGVPGVGVP) can be deleted
GVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVP

SEQ ID NO: 54 - protein, 800 aa, synthetic construct
  REGION 1..800: note = elastin-like polypeptide
  REPEAT 1..10: note = single repeat of (GVGVPGAGVP)m where m=5-80
  VARIANT 51..800: note = up to 75 copies of (GVGVPGAGVP) can be deleted
GVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVP

SEQ ID NO: 55 - protein, 800 aa, synthetic construct
  REGION 1..800: note = elastin-like polypeptide
  REPEAT 1..25: note = single repeat of (GVGVPGVGVPGLGVPGVGVPGVGVP)m where; m = 2-32
  VARIANT 51..800: note = up to 30 copies of (GVGVP) can be deleted
GVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVP

SEQ ID NO: 56 - protein, 800 aa, synthetic construct
  REGION 1..800: note = elastin-like polypeptide
  REPEAT 1..5: note = single repeat of (GXGVP)m where m=10-160
  VARIANT 51..800: note = up to 150 copies of (GXGVP) can be deleted
  VARIANT 2: note = G, A, V, I, L, F, Y, W, K, R, D, E or S
  VARIANT 7: note = G, A, V, I, L, F, Y, W, K, R, D, E or S
  VARIANT 12: note = G, A, V, I, L, F, Y, W, K, R, D, E or S
  VARIANT 17: note = G, A, V, I, L, F, Y, W, K, R, D, E or S
  VARIANT 22: note = G, A, V, I, L, F, Y, W, K, R, D, E or S
  VARIANT 27: note = G, A, V, I, L, F, Y, W, K, R, D, E or S
  VARIANT 32: note = G, A, V, I, L, F, Y, W, K, R, D, E or S
  VARIANT 37: note = G, A, V, I, L, F, Y, W, K, R, D, E or S
  VARIANT 42: note = G, A, V, I, L, F, Y, W, K, R, D, E or S
  VARIANT 47: note = G, A, V, I, L, F, Y, W, K, R, D, E or S
  VARIANT 52: note = G, A, V, I, L, F, Y, W, K, R, D, E or S
  VARIANT 57: note = G, A, V, I, L, F, Y, W, K, R, D, E or S
  VARIANT 62: note = G, A, V, I, L, F, Y, W, K, R, D, E or S
  VARIANT 67: note = G, A, V, I, L, F, Y, W, K, R, D, E or S
  VARIANT 72: note = G, A, V, I, L, F, Y, W, K, R, D, E or S
  VARIANT 77: note = G, A, V, I, L, F, Y, W, K, R, D, E or S
  VARIANT 82: note = G, A, V, I, L, F, Y, W, K, R, D, E or S
  VARIANT 87: note = G, A, V, I, L, F, Y, W, K, R, D, E or S
  VARIANT 92: note = G, A, V, I, L, F, Y, W, K, R, D, E or S
  VARIANT 97: note = G, A, V, I, L, F, Y, W, K, R, D, E or S
  VARIANT 102: note = G, A, V, I, L, F, Y, W, K, R, D, E or S
  VARIANT 107: note = G, A, V, I, L, F, Y, W, K, R, D, E or S
  VARIANT 112: note = G, A, V, I, L, F, Y, W, K, R, D, E or S
  VARIANT 117: note = G, A, V, I, L, F, Y, W, K, R, D, E or S
  VARIANT 122: note = G, A, V, I, L, F, Y, W, K, R, D, E or S
  VARIANT 127: note = G, A, V, I, L, F, Y, W, K, R, D, E or S
  VARIANT 132: note = G, A, V, I, L, F, Y, W, K, R, D, E or S
  VARIANT 137: note = G, A, V, I, L, F, Y, W, K, R, D, E or S
  VARIANT 142: note = G, A, V, I, L, F, Y, W, K, R, D, E or S
  VARIANT 147: note = G, A, V, I, L, F, Y, W, K, R, D, E or S
  VARIANT 152: note = G, A, V, I, L, F, Y, W, K, R, D, E or S
  VARIANT 157: note = G, A, V, I, L, F, Y, W, K, R, D, E or S
  VARIANT 162: note = G, A, V, I, L, F, Y, W, K, R, D, E or S
  VARIANT 167: note = G, A, V, I, L, F, Y, W, K, R, D, E or S
  VARIANT 172: note = G, A, V, I, L, F, Y, W, K, R, D, E or S
  VARIANT 177: note = G, A, V, I, L, F, Y, W, K, R, D, E or S
  VARIANT 182: note = G, A, V, I, L, F, Y, W, K, R, D, E or S
  VARIANT 187: note = G, A, V, I, L, F, Y, W, K, R, D, E or S
  VARIANT 192: note = G, A, V, I, L, F, Y, W, K, R, D, E or S
  VARIANT 197: note = G, A, V, I, L, F, Y, W, K, R, D, E or S
  VARIANT 202: note = G, A, V, I, L, F, Y, W, K, R, D, E or S
  VARIANT 207: note = G, A, V, I, L, F, Y, W, K, R, D, E or S
  VARIANT 212: note = G, A, V, I, L, F, Y, W, K, R, D, E or S
  VARIANT 217: note = G, A, V, I, L, F, Y, W, K, R, D, E or S
  VARIANT 222: note = G, A, V, I, L, F, Y, W, K, R, D, E or S
  VARIANT 227: note = G, A, V, I, L, F, Y, W, K, R, D, E or S
  VARIANT 232: note = G, A, V, I, L, F, Y, W, K, R, D, E or S
  VARIANT 237: note = G, A, V, I, L, F, Y, W, K, R, D, E or S
  VARIANT 242: note = G, A, V, I, L, F, Y, W, K, R, D, E or S
  VARIANT 247: note = G, A, V, I, L, F, Y, W, K, R, D, E or S
  VARIANT 252: note = G, A, V, I, L, F, Y, W, K, R, D, E or S
  VARIANT 257: note = G, A, V, I, L, F, Y, W, K, R, D, E or S
  VARIANT 262: note = G, A, V, I, L, F, Y, W, K, R, D, E or S
  VARIANT 267: note = G, A, V, I, L, F, Y, W, K, R, D, E or S
  VARIANT 272: note = G, A, V, I, L, F, Y, W, K, R, D, E or S
  VARIANT 277: note = G, A, V, I, L, F, Y, W, K, R, D, E or S
  VARIANT 282: note = G, A, V, I, L, F, Y, W, K, R, D, E or S
  VARIANT 287: note = G, A, V, I, L, F, Y, W, K, R, D, E or S
  VARIANT 292: note = G, A, V, I, L, F, Y, W, K, R, D, E or S
  VARIANT 297: note = G, A, V, I, L, F, Y, W, K, R, D, E or S
  VARIANT 302: note = G, A, V, I, L, F, Y, W, K, R, D, E or S
  VARIANT 307: note = G, A, V, I, L, F, Y, W, K, R, D, E or S
  VARIANT 312: note = G, A, V, I, L, F, Y, W, K, R, D, E or S
  VARIANT 317: note = G, A, V, I, L, F, Y, W, K, R, D, E or S
  VARIANT 322: note = G, A, V, I, L, F, Y, W, K, R, D, E or S
  VARIANT 327: note = G, A, V, I, L, F, Y, W, K, R, D, E or S
  VARIANT 332: note = G, A, V, I, L, F, Y, W, K, R, D, E or S
  VARIANT 337: note = G, A, V, I, L, F, Y, W, K, R, D, E or S
  VARIANT 342: note = G, A, V, I, L, F, Y, W, K, R, D, E or S
  VARIANT 347: note = G, A, V, I, L, F, Y, W, K, R, D, E or S
  VARIANT 352: note = G, A, V, I, L, F, Y, W, K, R, D, E or S
  VARIANT 357: note = G, A, V, I, L, F, Y, W, K, R, D, E or S
  VARIANT 362: note = G, A, V, I, L, F, Y, W, K, R, D, E or S
  VARIANT 367: note = G, A, V, I, L, F, Y, W, K, R, D, E or S
  VARIANT 372: note = G, A, V, I, L, F, Y, W, K, R, D, E or S
  VARIANT 377: note = G, A, V, I, L, F, Y, W, K, R, D, E or S
  VARIANT 382: note = G, A, V, I, L, F, Y, W, K, R, D, E or S
  VARIANT 387: note = G, A, V, I, L, F, Y, W, K, R, D, E or S
  VARIANT 392: note = G, A, V, I, L, F, Y, W, K, R, D, E or S
  VARIANT 397: note = G, A, V, I, L, F, Y, W, K, R, D, E or S
  VARIANT 402: note = G, A, V, I, L, F, Y, W, K, R, D, E or S
  VARIANT 407: note = G, A, V, I, L, F, Y, W, K, R, D, E or S
  VARIANT 412: note = G, A, V, I, L, F, Y, W, K, R, D, E or S
  VARIANT 417: note = G, A, V, I, L, F, Y, W, K, R, D, E or S
  VARIANT 422: note = G, A, V, I, L, F, Y, W, K, R, D, E or S
  VARIANT 427: note = G, A, V, I, L, F, Y, W, K, R, D, E or S
  VARIANT 432: note = G, A, V, I, L, F, Y, W, K, R, D, E or S
  VARIANT 437: note = G, A, V, I, L, F, Y, W, K, R, D, E or S
  VARIANT 442: note = G, A, V, I, L, F, Y, W, K, R, D, E or S
  VARIANT 447: note = G, A, V, I, L, F, Y, W, K, R, D, E or S
  VARIANT 452: note = G, A, V, I, L, F, Y, W, K, R, D, E or S
  VARIANT 457: note = G, A, V, I, L, F, Y, W, K, R, D, E or S
  VARIANT 462: note = G, A, V, I, L, F, Y, W, K, R, D, E or S
  VARIANT 467: note = G, A, V, I, L, F, Y, W, K, R, D, E or S
  VARIANT 472: note = G, A, V, I, L, F, Y, W, K, R, D, E or S
  VARIANT 477: note = G, A, V, I, L, F, Y, W, K, R, D, E or S
  VARIANT 482: note = G, A, V, I, L, F, Y, W, K, R, D, E or S
  VARIANT 487: note = G, A, V, I, L, F, Y, W, K, R, D, E or S
  VARIANT 492: note = G, A, V, I, L, F, Y, W, K, R, D, E or S
  VARIANT 497: note = G, A, V, I, L, F, Y, W, K, R, D, E or S
  VARIANT 502: note = G, A, V, I, L, F, Y, W, K, R, D, E or S
  VARIANT 507: note = G, A, V, I, L, F, Y, W, K, R, D, E or S
  VARIANT 512: note = G, A, V, I, L, F, Y, W, K, R, D, E or S
  VARIANT 517: note = G, A, V, I, L, F, Y, W, K, R, D, E or S
  VARIANT 522: note = G, A, V, I, L, F, Y, W, K, R, D, E or S
  VARIANT 527: note = G, A, V, I, L, F, Y, W, K, R, D, E or S
  VARIANT 532: note = G, A, V, I, L, F, Y, W, K, R, D, E or S
  VARIANT 537: note = G, A, V, I, L, F, Y, W, K, R, D, E or S
  VARIANT 542: note = G, A, V, I, L, F, Y, W, K, R, D, E or S
  VARIANT 547: note = G, A, V, I, L, F, Y, W, K, R, D, E or S
  VARIANT 552: note = G, A, V, I, L, F, Y, W, K, R, D, E or S
  VARIANT 557: note = G, A, V, I, L, F, Y, W, K, R, D, E or S
  VARIANT 562: note = G, A, V, I, L, F, Y, W, K, R, D, E or S
  VARIANT 567: note = G, A, V, I, L, F, Y, W, K, R, D, E or S
  VARIANT 572: note = G, A, V, I, L, F, Y, W, K, R, D, E or S
  VARIANT 577: note = G, A, V, I, L, F, Y, W, K, R, D, E or S
  VARIANT 582: note = G, A, V, I, L, F, Y, W, K, R, D, E or S
  VARIANT 587: note = G, A, V, I, L, F, Y, W, K, R, D, E or S
  VARIANT 592: note = G, A, V, I, L, F, Y, W, K, R, D, E or S
  VARIANT 597: note = G, A, V, I, L, F, Y, W, K, R, D, E or S
  VARIANT 602: note = G, A, V, I, L, F, Y, W, K, R, D, E or S
  VARIANT 607: note = G, A, V, I, L, F, Y, W, K, R, D, E or S
  VARIANT 612: note = G, A, V, I, L, F, Y, W, K, R, D, E or S
  VARIANT 617: note = G, A, V, I, L, F, Y, W, K, R, D, E or S
  VARIANT 622: note = G, A, V, I, L, F, Y, W, K, R, D, E or S
  VARIANT 627: note = G, A, V, I, L, F, Y, W, K, R, D, E or S
  VARIANT 632: note = G, A, V, I, L, F, Y, W, K, R, D, E or S
  VARIANT 637: note = G, A, V, I, L, F, Y, W, K, R, D, E or S
  VARIANT 642: note = G, A, V, I, L, F, Y, W, K, R, D, E or S
  VARIANT 647: note = G, A, V, I, L, F, Y, W, K, R, D, E or S
  VARIANT 652: note = G, A, V, I, L, F, Y, W, K, R, D, E or S
  VARIANT 657: note = G, A, V, I, L, F, Y, W, K, R, D, E or S
  VARIANT 662: note = G, A, V, I, L, F, Y, W, K, R, D, E or S
  VARIANT 667: note = G, A, V, I, L, F, Y, W, K, R, D, E or S
  VARIANT 672: note = G, A, V, I, L, F, Y, W, K, R, D, E or S
  VARIANT 677: note = G, A, V, I, L, F, Y, W, K, R, D, E or S
  VARIANT 682: note = G, A, V, I, L, F, Y, W, K, R, D, E or S
  VARIANT 687: note = G, A, V, I, L, F, Y, W, K, R, D, E or S
  VARIANT 692: note = G, A, V, I, L, F, Y, W, K, R, D, E or S
  VARIANT 697: note = G, A, V, I, L, F, Y, W, K, R, D, E or S
  VARIANT 702: note = G, A, V, I, L, F, Y, W, K, R, D, E or S
  VARIANT 707: note = G, A, V, I, L, F, Y, W, K, R, D, E or S
  VARIANT 712: note = G, A, V, I, L, F, Y, W, K, R, D, E or S
  VARIANT 717: note = G, A, V, I, L, F, Y, W, K, R, D, E or S
  VARIANT 722: note = G, A, V, I, L, F, Y, W, K, R, D, E or S
  VARIANT 727: note = G, A, V, I, L, F, Y, W, K, R, D, E or S
  VARIANT 732: note = G, A, V, I, L, F, Y, W, K, R, D, E or S
  VARIANT 737: note = G, A, V, I, L, F, Y, W, K, R, D, E or S
  VARIANT 742: note = G, A, V, I, L, F, Y, W, K, R, D, E or S
  VARIANT 747: note = G, A, V, I, L, F, Y, W, K, R, D, E or S
  VARIANT 752: note = G, A, V, I, L, F, Y, W, K, R, D, E or S
  VARIANT 757: note = G, A, V, I, L, F, Y, W, K, R, D, E or S
  VARIANT 762: note = G, A, V, I, L, F, Y, W, K, R, D, E or S
  VARIANT 767: note = G, A, V, I, L, F, Y, W, K, R, D, E or S
  VARIANT 772: note = G, A, V, I, L, F, Y, W, K, R, D, E or S
  VARIANT 777: note = G, A, V, I, L, F, Y, W, K, R, D, E or S
  VARIANT 782: note = G, A, V, I, L, F, Y, W, K, R, D, E or S
  VARIANT 787: note = G, A, V, I, L, F, Y, W, K, R, D, E or S
  VARIANT 792: note = G, A, V, I, L, F, Y, W, K, R, D, E or S
  VARIANT 797: note = G, A, V, I, L, F, Y, W, K, R, D, E or S
GXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVP

SEQ ID NO: 57 - protein, 1440 aa, synthetic construct
  REGION 1..1440: note = elastin-like polypeptide
  REPEAT 1..9: note = single repeat of (XXPXXXXGX)m where m=10-160
  VARIANT 91..1440: note = up to 150 copies of (GVGVP) can be deleted
  VARIANT 1: note = X can be any amino acid
  VARIANT 2: note = X can be any amino acid
  VARIANT 4: note = X can be any amino acid except P or G
  VARIANT 5: note = X can be any amino acid except P or G
  VARIANT 6: note = X can be any amino acid except P or G
  VARIANT 7: note = X can be any amino acid except P or G
  VARIANT 9: note = X can be any amino acid
  VARIANT 10: note = X can be any amino acid
  VARIANT 11: note = X can be any amino acid
  VARIANT 13: note = X can be any amino acid except P or G
  VARIANT 14: note = X can be any amino acid except P or G
  VARIANT 15: note = X can be any amino acid except P or G
  VARIANT 16: note = X can be any amino acid except P or G
  VARIANT 18: note = X can be any amino acid
  VARIANT 19: note = X can be any amino acid
  VARIANT 20: note = X can be any amino acid
  VARIANT 22: note = X can be any amino acid except P or G
  VARIANT 23: note = X can be any amino acid except P or G
  VARIANT 24: note = X can be any amino acid except P or G
  VARIANT 25: note = X can be any amino acid except P or G
  VARIANT 27: note = X can be any amino acid
  VARIANT 28: note = X can be any amino acid
  VARIANT 29: note = X can be any amino acid
  VARIANT 31: note = X can be any amino acid except P or G
  VARIANT 32: note = X can be any amino acid except P or G
  VARIANT 33: note = X can be any amino acid except P or G
  VARIANT 34: note = X can be any amino acid except P or G
  VARIANT 36: note = X can be any amino acid
  VARIANT 37: note = X can be any amino acid
  VARIANT 38: note = X can be any amino acid
  VARIANT 40: note = X can be any amino acid except P or G
  VARIANT 41: note = X can be any amino acid except P or G
  VARIANT 42: note = X can be any amino acid except P or G
  VARIANT 43: note = X can be any amino acid except P or G
  VARIANT 45: note = X can be any amino acid
  VARIANT 46: note = X can be any amino acid
  VARIANT 47: note = X can be any amino acid
  VARIANT 49: note = X can be any amino acid except P or G
  VARIANT 50: note = X can be any amino acid except P or G
  VARIANT 51: note = X can be any amino acid except P or G
  VARIANT 52: note = X can be any amino acid except P or G
  VARIANT 54: note = X can be any amino acid
  VARIANT 55: note = X can be any amino acid
  VARIANT 56: note = X can be any amino acid
  VARIANT 58: note = X can be any amino acid except P or G
  VARIANT 59: note = X can be any amino acid except P or G
  VARIANT 60: note = X can be any amino acid except P or G
  VARIANT 61: note = X can be any amino acid except P or G
  VARIANT 63: note = X can be any amino acid
  VARIANT 64: note = X can be any amino acid
  VARIANT 65: note = X can be any amino acid
  VARIANT 67: note = X can be any amino acid except P or G
  VARIANT 68: note = X can be any amino acid except P or G
  VARIANT 69: note = X can be any amino acid except P or G
  VARIANT 70: note = X can be any amino acid except P or G
  VARIANT 72: note = X can be any amino acid
  VARIANT 73: note = X can be any amino acid
  VARIANT 74: note = X can be any amino acid
  VARIANT 76: note = X can be any amino acid except P or G
  VARIANT 77: note = X can be any amino acid except P or G
  VARIANT 78: note = X can be any amino acid except P or G
  VARIANT 79: note = X can be any amino acid except P or G
  VARIANT 81: note = X can be any amino acid
  VARIANT 82: note = X can be any amino acid
  VARIANT 83: note = X can be any amino acid
  VARIANT 85: note = X can be any amino acid except P or G
  VARIANT 86: note = X can be any amino acid except P or G
  VARIANT 87: note = X can be any amino acid except P or G
  VARIANT 88: note = X can be any amino acid except P or G
  VARIANT 90: note = X can be any amino acid
  VARIANT 91..1440: note = May be present or absent in groups of the repeat unit X X Pro X X X X Gly Xaa
  VARIANT 91: note = X can be any amino acid
  VARIANT 92: note = X can be any amino acid
  VARIANT 94: note = X can be any amino acid except P or G
  VARIANT 95: note = X can be any amino acid except P or G
  VARIANT 96: note = X can be any amino acid except P or G
  VARIANT 97: note = X can be any amino acid except P or G
  VARIANT 99: note = X can be any amino acid
  VARIANT 100: note = X can be any amino acid
  VARIANT 101: note = X can be any amino acid
  VARIANT 103: note = X can be any amino acid except P or G
  VARIANT 104: note = X can be any amino acid except P or G
  VARIANT 105: note = X can be any amino acid except P or G
  VARIANT 106: note = X can be any amino acid except P or G
  VARIANT 108: note = X can be any amino acid
  VARIANT 109: note = X can be any amino acid
  VARIANT 110: note = X can be any amino acid
  VARIANT 112: note = X can be any amino acid except P or G
  VARIANT 113: note = X can be any amino acid except P or G
  VARIANT 114: note = X can be any amino acid except P or G
  VARIANT 115: note = X can be any amino acid except P or G
  VARIANT 117: note = X can be any amino acid
  VARIANT 118: note = X can be any amino acid
  VARIANT 119: note = X can be any amino acid
  VARIANT 121: note = X can be any amino acid except P or G
  VARIANT 122: note = X can be any amino acid except P or G
  VARIANT 123: note = X can be any amino acid except P or G
  VARIANT 124: note = X can be any amino acid except P or G
  VARIANT 126: note = X can be any amino acid
  VARIANT 127: note = X can be any amino acid
  VARIANT 128: note = X can be any amino acid
  VARIANT 130: note = X can be any amino acid except P or G
  VARIANT 131: note = X can be any amino acid except P or G
  VARIANT 132: note = X can be any amino acid except P or G
  VARIANT 133: note = X can be any amino acid except P or G
  VARIANT 135: note = X can be any amino acid
  VARIANT 136: note = X can be any amino acid
  VARIANT 137: note = X can be any amino acid
  VARIANT 139: note = X can be any amino acid except P or G
  VARIANT 140: note = X can be any amino acid except P or G
  VARIANT 141: note = X can be any amino acid except P or G
  VARIANT 142: note = X can be any amino acid except P or G
  VARIANT 144: note = X can be any amino acid
  VARIANT 145: note = X can be any amino acid
  VARIANT 146: note = X can be any amino acid
  VARIANT 148: note = X can be any amino acid except P or G
  VARIANT 149: note = X can be any amino acid except P or G
  VARIANT 150: note = X can be any amino acid except P or G
  VARIANT 151: note = X can be any amino acid except P or G
  VARIANT 153: note = X can be any amino acid
  VARIANT 154: note = X can be any amino acid
  VARIANT 155: note = X can be any amino acid
  VARIANT 157: note = X can be any amino acid except P or G
  VARIANT 158: note = X can be any amino acid except P or G
  VARIANT 159: note = X can be any amino acid except P or G
  VARIANT 160: note = X can be any amino acid except P or G
  VARIANT 162: note = X can be any amino acid
  VARIANT 163: note = X can be any amino acid
  VARIANT 164: note = X can be any amino acid
  VARIANT 166: note = X can be any amino acid except P or G
  VARIANT 167: note = X can be any amino acid except P or G
  VARIANT 168: note = X can be any amino acid except P or G
  VARIANT 169: note = X can be any amino acid except P or G
  VARIANT 171: note = X can be any amino acid
  VARIANT 172: note = X can be any amino acid
  VARIANT 173: note = X can be any amino acid
  VARIANT 175: note = X can be any amino acid except P or G
  VARIANT 176: note = X can be any amino acid except P or G
  VARIANT 177: note = X can be any amino acid except P or G
  VARIANT 178: note = X can be any amino acid except P or G
  VARIANT 180: note = X can be any amino acid
  VARIANT 181: note = X can be any amino acid
  VARIANT 182: note = X can be any amino acid
  VARIANT 184: note = X can be any amino acid except P or G
  VARIANT 185: note = X can be any amino acid except P or G
  VARIANT 186: note = X can be any amino acid except P or G
  VARIANT 187: note = X can be any amino acid except P or G
  VARIANT 189: note = X can be any amino acid
  VARIANT 190: note = X can be any amino acid
  VARIANT 191: note = X can be any amino acid
  VARIANT 193: note = X can be any amino acid except P or G
  VARIANT 194: note = X can be any amino acid except P or G
  VARIANT 195: note = X can be any amino acid except P or G
  VARIANT 196: note = X can be any amino acid except P or G
  VARIANT 198: note = X can be any amino acid
  VARIANT 199: note = X can be any amino acid
  VARIANT 200: note = X can be any amino acid
  VARIANT 202: note = X can be any amino acid except P or G
  VARIANT 203: note = X can be any amino acid except P or G
  VARIANT 204: note = X can be any amino acid except P or G
  VARIANT 205: note = X can be any amino acid except P or G
  VARIANT 207: note = X can be any amino acid
  VARIANT 208: note = X can be any amino acid
  VARIANT 209: note = X can be any amino acid
  VARIANT 211: note = X can be any amino acid except P or G
  VARIANT 212: note = X can be any amino acid except P or G
  VARIANT 213: note = X can be any amino acid except P or G
  VARIANT 214: note = X can be any amino acid except P or G
  VARIANT 216: note = X can be any amino acid
  VARIANT 217: note = X can be any amino acid
  VARIANT 218: note = X can be any amino acid
  VARIANT 220: note = X can be any amino acid except P or G
  VARIANT 221: note = X can be any amino acid except P or G
  VARIANT 222: note = X can be any amino acid except P or G
  VARIANT 223: note = X can be any amino acid except P or G
  VARIANT 225: note = X can be any amino acid
  VARIANT 226: note = X can be any amino acid
  VARIANT 227: note = X can be any amino acid
  VARIANT 229: note = X can be any amino acid except P or G
  VARIANT 230: note = X can be any amino acid except P or G
  VARIANT 231: note = X can be any amino acid except P or G
  VARIANT 232: note = X can be any amino acid except P or G
  VARIANT 234: note = X can be any amino acid
  VARIANT 235: note = X can be any amino acid
  VARIANT 236: note = X can be any amino acid
  VARIANT 238: note = X can be any amino acid except P or G
  VARIANT 239: note = X can be any amino acid except P or G
  VARIANT 240: note = X can be any amino acid except P or G
  VARIANT 241: note = X can be any amino acid except P or G
  VARIANT 243: note = X can be any amino acid
  VARIANT 244: note = X can be any amino acid
  VARIANT 245: note = X can be any amino acid
  VARIANT 247: note = X can be any amino acid except P or G
  VARIANT 248: note = X can be any amino acid except P or G
  VARIANT 249: note = X can be any amino acid except P or G
  VARIANT 250: note = X can be any amino acid except P or G
  VARIANT 252: note = X can be any amino acid
  VARIANT 253: note = X can be any amino acid
  VARIANT 254: note = X can be any amino acid
  VARIANT 256: note = X can be any amino acid except P or G
  VARIANT 257: note = X can be any amino acid except P or G
  VARIANT 258: note = X can be any amino acid except P or G
  VARIANT 259: note = X can be any amino acid except P or G
  VARIANT 261: note = X can be any amino acid
  VARIANT 262: note = X can be any amino acid
  VARIANT 263: note = X can be any amino acid
  VARIANT 265: note = X can be any amino acid except P or G
  VARIANT 266: note = X can be any amino acid except P or G
  VARIANT 267: note = X can be any amino acid except P or G
  VARIANT 268: note = X can be any amino acid except P or G
  VARIANT 270: note = X can be any amino acid
  VARIANT 271: note = X can be any amino acid
  VARIANT 272: note = X can be any amino acid
  VARIANT 274: note = X can be any amino acid except P or G
  VARIANT 275: note = X can be any amino acid except P or G
  VARIANT 276: note = X can be any amino acid except P or G
  VARIANT 277: note = X can be any amino acid except P or G
  VARIANT 279: note = X can be any amino acid
  VARIANT 280: note = X can be any amino acid
  VARIANT 281: note = X can be any amino acid
  VARIANT 283: note = X can be any amino acid except P or G
  VARIANT 284: note = X can be any amino acid except P or G
  VARIANT 285: note = X can be any amino acid except P or G
  VARIANT 286: note = X can be any amino acid except P or G
  VARIANT 288: note = X can be any amino acid
  VARIANT 289: note = X can be any amino acid
  VARIANT 290: note = X can be any amino acid
  VARIANT 292: note = X can be any amino acid except P or G
  VARIANT 293: note = X can be any amino acid except P or G
  VARIANT 294: note = X can be any amino acid except P or G
  VARIANT 295: note = X can be any amino acid except P or G
  VARIANT 297: note = X can be any amino acid
  VARIANT 298: note = X can be any amino acid
  VARIANT 299: note = X can be any amino acid
  VARIANT 301: note = X can be any amino acid except P or G
  VARIANT 302: note = X can be any amino acid except P or G
  VARIANT 303: note = X can be any amino acid except P or G
  VARIANT 304: note = X can be any amino acid except P or G
  VARIANT 306: note = X can be any amino acid
  VARIANT 307: note = X can be any amino acid
  VARIANT 308: note = X can be any amino acid
  VARIANT 310: note = X can be any amino acid except P or G
  VARIANT 311: note = X can be any amino acid except P or G
  VARIANT 312: note = X can be any amino acid except P or G
  VARIANT 313: note = X can be any amino acid except P or G
  VARIANT 315: note = X can be any amino acid
  VARIANT 316: note = X can be any amino acid
  VARIANT 317: note = X can be any amino acid
  VARIANT 319: note = X can be any amino acid except P or G
  VARIANT 320: note = X can be any amino acid except P or G
  VARIANT 321: note = X can be any amino acid except P or G
  VARIANT 322: note = X can be any amino acid except P or G
  VARIANT 324: note = X can be any amino acid
  VARIANT 325: note = X can be any amino acid
  VARIANT 326: note = X can be any amino acid
  VARIANT 328: note = X can be any amino acid except P or G
  VARIANT 329: note = X can be any amino acid except P or G
  VARIANT 330: note = X can be any amino acid except P or G
  VARIANT 331: note = X can be any amino acid except P or G
  VARIANT 333: note = X can be any amino acid
  VARIANT 334: note = X can be any amino acid
  VARIANT 335: note = X can be any amino acid
  VARIANT 337: note = X can be any amino acid except P or G
  VARIANT 338: note = X can be any amino acid except P or G
  VARIANT 339: note = X can be any amino acid except P or G
  VARIANT 340: note = X can be any amino acid except P or G
  VARIANT 342: note = X can be any amino acid
  VARIANT 343: note = X can be any amino acid
  VARIANT 344: note = X can be any amino acid
  VARIANT 346: note = X can be any amino acid except P or G
  VARIANT 347: note = X can be any amino acid except P or G
  VARIANT 348: note = X can be any amino acid except P or G
  VARIANT 349: note = X can be any amino acid except P or G
  VARIANT 351: note = X can be any amino acid
  VARIANT 352: note = X can be any amino acid
  VARIANT 353: note = X can be any amino acid
  VARIANT 355: note = X can be any amino acid except P or G
  VARIANT 356: note = X can be any amino acid except P or G
  VARIANT 357: note = X can be any amino acid except P or G
  VARIANT 358: note = X can be any amino acid except P or G
  VARIANT 360: note = X can be any amino acid
  VARIANT 361: note = X can be any amino acid
  VARIANT 362: note = X can be any amino acid
  VARIANT 364: note = X can be any amino acid except P or G
  VARIANT 365: note = X can be any amino acid except P or G
  VARIANT 366: note = X can be any amino acid except P or G
  VARIANT 367: note = X can be any amino acid except P or G
  VARIANT 369: note = X can be any amino acid
  VARIANT 370: note = X can be any amino acid
  VARIANT 371: note = X can be any amino acid
  VARIANT 373: note = X can be any amino acid except P or G
  VARIANT 374: note = X can be any amino acid except P or G
  VARIANT 375: note = X can be any amino acid except P or G
  VARIANT 376: note = X can be any amino acid except P or G
  VARIANT 378: note = X can be any amino acid
  VARIANT 379: note = X can be any amino acid
  VARIANT 380: note = X can be any amino acid
  VARIANT 382: note = X can be any amino acid except P or G
  VARIANT 383: note = X can be any amino acid except P or G
  VARIANT 384: note = X can be any amino acid except P or G
  VARIANT 385: note = X can be any amino acid except P or G
  VARIANT 387: note = X can be any amino acid
  VARIANT 388: note = X can be any amino acid
  VARIANT 389: note = X can be any amino acid
  VARIANT 391: note = X can be any amino acid except P or G
  VARIANT 392: note = X can be any amino acid except P or G
  VARIANT 393: note = X can be any amino acid except P or G
  VARIANT 394: note = X can be any amino acid except P or G
  VARIANT 396: note = X can be any amino acid
  VARIANT 397: note = X can be any amino acid
  VARIANT 398: note = X can be any amino acid
  VARIANT 400: note = X can be any amino acid except P or G
  VARIANT 401: note = X can be any amino acid except P or G
  VARIANT 402: note = X can be any amino acid except P or G
  VARIANT 403: note = X can be any amino acid except P or G
  VARIANT 405: note = X can be any amino acid
  VARIANT 406: note = X can be any amino acid
  VARIANT 407: note = X can be any amino acid
  VARIANT 409: note = X can be any amino acid except P or G
  VARIANT 410: note = X can be any amino acid except P or G
  VARIANT 411: note = X can be any amino acid except P or G
  VARIANT 412: note = X can be any amino acid except P or G
  VARIANT 414: note = X can be any amino acid
  VARIANT 415: note = X can be any amino acid
  VARIANT 416: note = X can be any amino acid
  VARIANT 418: note = X can be any amino acid except P or G
  VARIANT 419: note = X can be any amino acid except P or G
  VARIANT 420: note = X can be any amino acid except P or G
  VARIANT 421: note = X can be any amino acid except P or G
  VARIANT 423: note = X can be any amino acid
  VARIANT 424: note = X can be any amino acid
  VARIANT 425: note = X can be any amino acid
  VARIANT 427: note = X can be any amino acid except P or G
  VARIANT 428: note = X can be any amino acid except P or G
  VARIANT 429: note = X can be any amino acid except P or G
  VARIANT 430: note = X can be any amino acid except P or G
  VARIANT 432: note = X can be any amino acid
  VARIANT 433: note = X can be any amino acid
  VARIANT 434: note = X can be any amino acid
  VARIANT 436: note = X can be any amino acid except P or G
  VARIANT 437: note = X can be any amino acid except P or G
  VARIANT 438: note = X can be any amino acid except P or G
  VARIANT 439: note = X can be any amino acid except P or G
  VARIANT 441: note = X can be any amino acid
  VARIANT 442: note = X can be any amino acid
  VARIANT 443: note = X can be any amino acid
  VARIANT 445: note = X can be any amino acid except P or G
  VARIANT 446: note = X can be any amino acid except P or G
  VARIANT 447: note = X can be any amino acid except P or G
  VARIANT 448: note = X can be any amino acid except P or G
  VARIANT 450: note = X can be any amino acid
  VARIANT 451: note = X can be any amino acid
  VARIANT 452: note = X can be any amino acid
  VARIANT 454: note = X can be any amino acid except P or G
  VARIANT 455: note = X can be any amino acid except P or G
  VARIANT 456: note = X can be any amino acid except P or G
  VARIANT 457: note = X can be any amino acid except P or G
  VARIANT 459: note = X can be any amino acid
  VARIANT 460: note = X can be any amino acid
  VARIANT 461: note = X can be any amino acid
  VARIANT 463: note = X can be any amino acid except P or G
  VARIANT 464: note = X can be any amino acid except P or G
  VARIANT 465: note = X can be any amino acid except P or G
  VARIANT 466: note = X can be any amino acid except P or G
  VARIANT 468: note = X can be any amino acid
  VARIANT 469: note = X can be any amino acid
  VARIANT 470: note = X can be any amino acid
  VARIANT 472: note = X can be any amino acid except P or G
  VARIANT 473: note = X can be any amino acid except P or G
  VARIANT 474: note = X can be any amino acid except P or G
  VARIANT 475: note = X can be any amino acid except P or G
  VARIANT 477: note = X can be any amino acid
  VARIANT 478: note = X can be any amino acid
  VARIANT 479: note = X can be any amino acid
  VARIANT 481: note = X can be any amino acid except P or G
  VARIANT 482: note = X can be any amino acid except P or G
  VARIANT 483: note = X can be any amino acid except P or G
  VARIANT 484: note = X can be any amino acid except P or G
  VARIANT 486: note = X can be any amino acid
  VARIANT 487: note = X can be any amino acid
  VARIANT 488: note = X can be any amino acid
  VARIANT 490: note = X can be any amino acid except P or G
  VARIANT 491: note = X can be any amino acid except P or G
  VARIANT 492: note = X can be any amino acid except P or G
  VARIANT 493: note = X can be any amino acid except P or G
  VARIANT 495: note = X can be any amino acid
  VARIANT 496: note = X can be any amino acid
  VARIANT 497: note = X can be any amino acid
  VARIANT 499: note = X can be any amino acid except P or G
  VARIANT 500: note = X can be any amino acid except P or G
  VARIANT 501: note = X can be any amino acid except P or G
  VARIANT 502: note = X can be any amino acid except P or G
  VARIANT 504: note = X can be any amino acid
  VARIANT 505: note = X can be any amino acid
  VARIANT 506: note = X can be any amino acid
  VARIANT 508: note = X can be any amino acid except P or G
  VARIANT 509: note = X can be any amino acid except P or G
  VARIANT 510: note = X can be any amino acid except P or G
  VARIANT 511: note = X can be any amino acid except P or G
  VARIANT 513: note = X can be any amino acid
  VARIANT 514: note = X can be any amino acid
  VARIANT 515: note = X can be any amino acid
  VARIANT 517: note = X can be any amino acid except P or G
  VARIANT 518: note = X can be any amino acid except P or G
  VARIANT 519: note = X can be any amino acid except P or G
  VARIANT 520: note = X can be any amino acid except P or G
  VARIANT 522: note = X can be any amino acid
  VARIANT 523: note = X can be any amino acid
  VARIANT 524: note = X can be any amino acid
  VARIANT 526: note = X can be any amino acid except P or G
  VARIANT 527: note = X can be any amino acid except P or G
  VARIANT 528: note = X can be any amino acid except P or G
  VARIANT 529: note = X can be any amino acid except P or G
  VARIANT 531: note = X can be any amino acid
  VARIANT 532: note = X can be any amino acid
  VARIANT 533: note = X can be any amino acid
  VARIANT 535: note = X can be any amino acid except P or G
  VARIANT 536: note = X can be any amino acid except P or G
  VARIANT 537: note = X can be any amino acid except P or G
  VARIANT 538: note = X can be any amino acid except P or G
  VARIANT 540: note = X can be any amino acid
  VARIANT 541: note = X can be any amino acid
  VARIANT 542: note = X can be any amino acid
  VARIANT 544: note = X can be any amino acid except P or G
  VARIANT 545: note = X can be any amino acid except P or G
  VARIANT 546: note = X can be any amino acid except P or G
  VARIANT 547: note = X can be any amino acid except P or G
  VARIANT 549: note = X can be any amino acid
  VARIANT 550: note = X can be any amino acid
  VARIANT 551: note = X can be any amino acid
  VARIANT 553: note = X can be any amino acid except P or G
  VARIANT 554: note = X can be any amino acid except P or G
  VARIANT 555: note = X can be any amino acid except P or G
  VARIANT 556: note = X can be any amino acid except P or G
  VARIANT 558: note = X can be any amino acid
  VARIANT 559: note = X can be any amino acid
  VARIANT 560: note = X can be any amino acid
  VARIANT 562: note = X can be any amino acid except P or G
  VARIANT 563: note = X can be any amino acid except P or G
  VARIANT 564: note = X can be any amino acid except P or G
  VARIANT 565: note = X can be any amino acid except P or G
  VARIANT 567: note = X can be any amino acid
  VARIANT 568: note = X can be any amino acid
  VARIANT 569: note = X can be any amino acid
  VARIANT 571: note = X can be any amino acid except P or G
  VARIANT 572: note = X can be any amino acid except P or G
  VARIANT 573: note = X can be any amino acid except P or G
  VARIANT 574: note = X can be any amino acid except P or G
  VARIANT 576: note = X can be any amino acid
  VARIANT 577: note = X can be any amino acid
  VARIANT 578: note = X can be any amino acid
  VARIANT 580: note = X can be any amino acid except P or G
  VARIANT 581: note = X can be any amino acid except P or G
  VARIANT 582: note = X can be any amino acid except P or G
  VARIANT 583: note = X can be any amino acid except P or G
  VARIANT 585: note = X can be any amino acid
  VARIANT 586: note = X can be any amino acid
  VARIANT 587: note = X can be any amino acid
  VARIANT 589: note = X can be any amino acid except P or G
  VARIANT 590: note = X can be any amino acid except P or G
  VARIANT 591: note = X can be any amino acid except P or G
  VARIANT 592: note = X can be any amino acid except P or G
  VARIANT 594: note = X can be any amino acid
  VARIANT 595: note = X can be any amino acid
  VARIANT 596: note = X can be any amino acid
  VARIANT 598: note = X can be any amino acid except P or G
  VARIANT 599: note = X can be any amino acid except P or G
  VARIANT 600: note = X can be any amino acid except P or G
  VARIANT 601: note = X can be any amino acid except P or G
  VARIANT 603: note = X can be any amino acid
  VARIANT 604: note = X can be any amino acid
  VARIANT 605: note = X can be any amino acid
  VARIANT 607: note = X can be any amino acid except P or G
  VARIANT 608: note = X can be any amino acid except P or G
  VARIANT 609: note = X can be any amino acid except P or G
  VARIANT 610: note = X can be any amino acid except P or G
  VARIANT 612: note = X can be any amino acid
  VARIANT 613: note = X can be any amino acid
  VARIANT 614: note = X can be any amino acid
  VARIANT 616: note = X can be any amino acid except P or G
  VARIANT 617: note = X can be any amino acid except P or G
  VARIANT 618: note = X can be any amino acid except P or G
  VARIANT 619: note = X can be any amino acid except P or G
  VARIANT 621: note = X can be any amino acid
  VARIANT 622: note = X can be any amino acid
  VARIANT 623: note = X can be any amino acid
  VARIANT 625: note = X can be any amino acid except P or G
  VARIANT 626: note = X can be any amino acid except P or G
  VARIANT 627: note = X can be any amino acid except P or G
  VARIANT 628: note = X can be any amino acid except P or G
  VARIANT 630: note = X can be any amino acid
  VARIANT 631: note = X can be any amino acid
  VARIANT 632: note = X can be any amino acid
  VARIANT 634: note = X can be any amino acid except P or G
  VARIANT 635: note = X can be any amino acid except P or G
  VARIANT 636: note = X can be any amino acid except P or G
  VARIANT 637: note = X can be any amino acid except P or G
  VARIANT 639: note = X can be any amino acid
  VARIANT 640: note = X can be any amino acid
  VARIANT 641: note = X can be any amino acid
  VARIANT 643: note = X can be any amino acid except P or G
  VARIANT 644: note = X can be any amino acid except P or G
  VARIANT 645: note = X can be any amino acid except P or G
  VARIANT 646: note = X can be any amino acid except P or G
  VARIANT 648: note = X can be any amino acid
  VARIANT 649: note = X can be any amino acid
  VARIANT 650: note = X can be any amino acid
  VARIANT 652: note = X can be any amino acid except P or G
  VARIANT 653: note = X can be any amino acid except P or G
  VARIANT 654: note = X can be any amino acid except P or G
  VARIANT 655: note = X can be any amino acid except P or G
  VARIANT 657: note = X can be any amino acid
  VARIANT 658: note = X can be any amino acid
  VARIANT 659: note = X can be any amino acid
  VARIANT 661: note = X can be any amino acid except P or G
  VARIANT 662: note = X can be any amino acid except P or G
  VARIANT 663: note = X can be any amino acid except P or G
  VARIANT 664: note = X can be any amino acid except P or G
  VARIANT 666: note = X can be any amino acid
  VARIANT 667: note = X can be any amino acid
  VARIANT 668: note = X can be any amino acid
  VARIANT 670: note = X can be any amino acid except P or G
  VARIANT 671: note = X can be any amino acid except P or G
  VARIANT 672: note = X can be any amino acid except P or G
  VARIANT 673: note = X can be any amino acid except P or G
  VARIANT 675: note = X can be any amino acid
  VARIANT 676: note = X can be any amino acid
  VARIANT 677: note = X can be any amino acid
  VARIANT 679: note = X can be any amino acid except P or G
  VARIANT 680: note = X can be any amino acid except P or G
  VARIANT 681: note = X can be any amino acid except P or G
  VARIANT 682: note = X can be any amino acid except P or G
  VARIANT 684: note = X can be any amino acid
  VARIANT 685: note = X can be any amino acid
  VARIANT 686: note = X can be any amino acid
  VARIANT 688: note = X can be any amino acid except P or G
  VARIANT 689: note = X can be any amino acid except P or G
  VARIANT 690: note = X can be any amino acid except P or G
  VARIANT 691: note = X can be any amino acid except P or G
  VARIANT 693: note = X can be any amino acid
  VARIANT 694: note = X can be any amino acid
  VARIANT 695: note = X can be any amino acid
  VARIANT 697: note = X can be any amino acid except P or G
  VARIANT 698: note = X can be any amino acid except P or G
  VARIANT 699: note = X can be any amino acid except P or G
  VARIANT 700: note = X can be any amino acid except P or G
  VARIANT 702: note = X can be any amino acid
  VARIANT 703: note = X can be any amino acid
  VARIANT 704: note = X can be any amino acid
  VARIANT 706: note = X can be any amino acid except P or G
  VARIANT 707: note = X can be any amino acid except P or G
  VARIANT 708: note = X can be any amino acid except P or G
  VARIANT 709: note = X can be any amino acid except P or G
  VARIANT 711: note = X can be any amino acid
  VARIANT 712: note = X can be any amino acid
  VARIANT 713: note = X can be any amino acid
  VARIANT 715: note = X can be any amino acid except P or G
  VARIANT 716: note = X can be any amino acid except P or G
  VARIANT 717: note = X can be any amino acid except P or G
  VARIANT 718: note = X can be any amino acid except P or G
  VARIANT 720: note = X can be any amino acid
  VARIANT 721: note = X can be any amino acid
  VARIANT 722: note = X can be any amino acid
  VARIANT 724: note = X can be any amino acid except P or G
  VARIANT 725: note = X can be any amino acid except P or G
  VARIANT 726: note = X can be any amino acid except P or G
  VARIANT 727: note = X can be any amino acid except P or G
  VARIANT 729: note = X can be any amino acid
  VARIANT 730: note = X can be any amino acid
  VARIANT 731: note = X can be any amino acid
  VARIANT 733: note = X can be any amino acid except P or G
  VARIANT 734: note = X can be any amino acid except P or G
  VARIANT 735: note = X can be any amino acid except P or G
  VARIANT 736: note = X can be any amino acid except P or G
  VARIANT 738: note = X can be any amino acid
  VARIANT 739: note = X can be any amino acid
  VARIANT 740: note = X can be any amino acid
  VARIANT 742: note = X can be any amino acid except P or G
  VARIANT 743: note = X can be any amino acid except P or G
  VARIANT 744: note = X can be any amino acid except P or G
  VARIANT 745: note = X can be any amino acid except P or G
  VARIANT 747: note = X can be any amino acid
  VARIANT 748: note = X can be any amino acid
  VARIANT 749: note = X can be any amino acid
  VARIANT 751: note = X can be any amino acid except P or G
  VARIANT 752: note = X can be any amino acid except P or G
  VARIANT 753: note = X can be any amino acid except P or G
  VARIANT 754: note = X can be any amino acid except P or G
  VARIANT 756: note = X can be any amino acid
  VARIANT 757: note = X can be any amino acid
  VARIANT 758: note = X can be any amino acid
  VARIANT 760: note = X can be any amino acid except P or G
  VARIANT 761: note = X can be any amino acid except P or G
  VARIANT 762: note = X can be any amino acid except P or G
  VARIANT 763: note = X can be any amino acid except P or G
  VARIANT 765: note = X can be any amino acid
  VARIANT 766: note = X can be any amino acid
  VARIANT 767: note = X can be any amino acid
  VARIANT 769: note = X can be any amino acid except P or G
  VARIANT 770: note = X can be any amino acid except P or G
  VARIANT 771: note = X can be any amino acid except P or G
  VARIANT 772: note = X can be any amino acid except P or G
  VARIANT 774: note = X can be any amino acid
  VARIANT 775: note = X can be any amino acid
  VARIANT 776: note = X can be any amino acid
  VARIANT 778: note = X can be any amino acid except P or G
  VARIANT 779: note = X can be any amino acid except P or G
  VARIANT 780: note = X can be any amino acid except P or G
  VARIANT 781: note = X can be any amino acid except P or G
  VARIANT 783: note = X can be any amino acid
  VARIANT 784: note = X can be any amino acid
  VARIANT 785: note = X can be any amino acid
  VARIANT 787: note = X can be any amino acid except P or G
  VARIANT 788: note = X can be any amino acid except P or G
  VARIANT 789: note = X can be any amino acid except P or G
  VARIANT 790: note = X can be any amino acid except P or G
  VARIANT 792: note = X can be any amino acid
  VARIANT 793: note = X can be any amino acid
  VARIANT 794: note = X can be any amino acid
  VARIANT 796: note = X can be any amino acid except P or G
  VARIANT 797: note = X can be any amino acid except P or G
  VARIANT 798: note = X can be any amino acid except P or G
  VARIANT 799: note = X can be any amino acid except P or G
  VARIANT 801: note = X can be any amino acid
  VARIANT 802: note = X can be any amino acid
  VARIANT 803: note = X can be any amino acid
  VARIANT 805: note = X can be any amino acid except P or G
  VARIANT 806: note = X can be any amino acid except P or G
  VARIANT 807: note = X can be any amino acid except P or G
  VARIANT 808: note = X can be any amino acid except P or G
  VARIANT 810: note = X can be any amino acid
  VARIANT 811: note = X can be any amino acid
  VARIANT 812: note = X can be any amino acid
  VARIANT 814: note = X can be any amino acid except P or G
  VARIANT 815: note = X can be any amino acid except P or G
  VARIANT 816: note = X can be any amino acid except P or G
  VARIANT 817: note = X can be any amino acid except P or G
  VARIANT 819: note = X can be any amino acid
  VARIANT 820: note = X can be any amino acid
  VARIANT 821: note = X can be any amino acid
  VARIANT 823: note = X can be any amino acid except P or G
  VARIANT 824: note = X can be any amino acid except P or G
  VARIANT 825: note = X can be any amino acid except P or G
  VARIANT 826: note = X can be any amino acid except P or G
  VARIANT 828: note = X can be any amino acid
  VARIANT 829: note = X can be any amino acid
  VARIANT 830: note = X can be any amino acid
  VARIANT 832: note = X can be any amino acid except P or G
  VARIANT 833: note = X can be any amino acid except P or G
  VARIANT 834: note = X can be any amino acid except P or G
  VARIANT 835: note = X can be any amino acid except P or G
  VARIANT 837: note = X can be any amino acid
  VARIANT 838: note = X can be any amino acid
  VARIANT 839: note = X can be any amino acid
  VARIANT 841: note = X can be any amino acid except P or G
  VARIANT 842: note = X can be any amino acid except P or G
  VARIANT 843: note = X can be any amino acid except P or G
  VARIANT 844: note = X can be any amino acid except P or G
  VARIANT 846: note = X can be any amino acid
  VARIANT 847: note = X can be any amino acid
  VARIANT 848: note = X can be any amino acid
  VARIANT 850: note = X can be any amino acid except P or G
  VARIANT 851: note = X can be any amino acid except P or G
  VARIANT 852: note = X can be any amino acid except P or G
  VARIANT 853: note = X can be any amino acid except P or G
  VARIANT 855: note = X can be any amino acid
  VARIANT 856: note = X can be any amino acid
  VARIANT 857: note = X can be any amino acid
  VARIANT 859: note = X can be any amino acid except P or G
  VARIANT 860: note = X can be any amino acid except P or G
  VARIANT 861: note = X can be any amino acid except P or G
  VARIANT 862: note = X can be any amino acid except P or G
  VARIANT 864: note = X can be any amino acid
  VARIANT 865: note = X can be any amino acid
  VARIANT 866: note = X can be any amino acid
  VARIANT 868: note = X can be any amino acid except P or G
  VARIANT 869: note = X can be any amino acid except P or G
  VARIANT 870: note = X can be any amino acid except P or G
  VARIANT 871: note = X can be any amino acid except P or G
  VARIANT 873: note = X can be any amino acid
  VARIANT 874: note = X can be any amino acid
  VARIANT 875: note = X can be any amino acid
  VARIANT 877: note = X can be any amino acid except P or G
  VARIANT 878: note = X can be any amino acid except P or G
  VARIANT 879: note = X can be any amino acid except P or G
  VARIANT 880: note = X can be any amino acid except P or G
  VARIANT 882: note = X can be any amino acid
  VARIANT 883: note = X can be any amino acid
  VARIANT 884: note = X can be any amino acid
  VARIANT 886: note = X can be any amino acid except P or G
  VARIANT 887: note = X can be any amino acid except P or G
  VARIANT 888: note = X can be any amino acid except P or G
  VARIANT 889: note = X can be any amino acid except P or G
  VARIANT 891: note = X can be any amino acid
  VARIANT 892: note = X can be any amino acid
  VARIANT 893: note = X can be any amino acid
  VARIANT 895: note = X can be any amino acid except P or G
  VARIANT 896: note = X can be any amino acid except P or G
  VARIANT 897: note = X can be any amino acid except P or G
  VARIANT 898: note = X can be any amino acid except P or G
  VARIANT 900: note = X can be any amino acid
  VARIANT 901: note = X can be any amino acid
  VARIANT 902: note = X can be any amino acid
  VARIANT 904: note = X can be any amino acid except P or G
  VARIANT 905: note = X can be any amino acid except P or G
  VARIANT 906: note = X can be any amino acid except P or G
  VARIANT 907: note = X can be any amino acid except P or G
  VARIANT 909: note = X can be any amino acid
  VARIANT 910: note = X can be any amino acid
  VARIANT 911: note = X can be any amino acid
  VARIANT 913: note = X can be any amino acid except P or G
  VARIANT 914: note = X can be any amino acid except P or G
  VARIANT 915: note = X can be any amino acid except P or G
  VARIANT 916: note = X can be any amino acid except P or G
  VARIANT 918: note = X can be any amino acid
  VARIANT 919: note = X can be any amino acid
  VARIANT 920: note = X can be any amino acid
  VARIANT 922: note = X can be any amino acid except P or G
  VARIANT 923: note = X can be any amino acid except P or G
  VARIANT 924: note = X can be any amino acid except P or G
  VARIANT 925: note = X can be any amino acid except P or G
  VARIANT 927: note = X can be any amino acid
  VARIANT 928: note = X can be any amino acid
  VARIANT 929: note = X can be any amino acid
  VARIANT 931: note = X can be any amino acid except P or G
  VARIANT 932: note = X can be any amino acid except P or G
  VARIANT 933: note = X can be any amino acid except P or G
  VARIANT 934: note = X can be any amino acid except P or G
  VARIANT 936: note = X can be any amino acid
  VARIANT 937: note = X can be any amino acid
  VARIANT 938: note = X can be any amino acid
  VARIANT 940: note = X can be any amino acid except P or G
  VARIANT 941: note = X can be any amino acid except P or G
  VARIANT 942: note = X can be any amino acid except P or G
  VARIANT 943: note = X can be any amino acid except P or G
  VARIANT 945: note = X can be any amino acid
  VARIANT 946: note = X can be any amino acid
  VARIANT 947: note = X can be any amino acid
  VARIANT 949: note = X can be any amino acid except P or G
  VARIANT 950: note = X can be any amino acid except P or G
  VARIANT 951: note = X can be any amino acid except P or G
  VARIANT 952: note = X can be any amino acid except P or G
  VARIANT 954: note = X can be any amino acid
  VARIANT 955: note = X can be any amino acid
  VARIANT 956: note = X can be any amino acid
  VARIANT 958: note = X can be any amino acid except P or G
  VARIANT 959: note = X can be any amino acid except P or G
  VARIANT 960: note = X can be any amino acid except P or G
  VARIANT 961: note = X can be any amino acid except P or G
  VARIANT 963: note = X can be any amino acid
  VARIANT 964: note = X can be any amino acid
  VARIANT 965: note = X can be any amino acid
  VARIANT 967: note = X can be any amino acid except P or G
  VARIANT 968: note = X can be any amino acid except P or G
  VARIANT 969: note = X can be any amino acid except P or G
  VARIANT 970: note = X can be any amino acid except P or G
  VARIANT 972: note = X can be any amino acid
  VARIANT 973: note = X can be any amino acid
  VARIANT 974: note = X can be any amino acid
  VARIANT 976: note = X can be any amino acid except P or G
  VARIANT 977: note = X can be any amino acid except P or G
  VARIANT 978: note = X can be any amino acid except P or G
  VARIANT 979: note = X can be any amino acid except P or G
  VARIANT 981: note = X can be any amino acid
  VARIANT 982: note = X can be any amino acid
  VARIANT 983: note = X can be any amino acid
  VARIANT 985: note = X can be any amino acid except P or G
  VARIANT 986: note = X can be any amino acid except P or G
  VARIANT 987: note = X can be any amino acid except P or G
  VARIANT 988: note = X can be any amino acid except P or G
  VARIANT 990: note = X can be any amino acid
  VARIANT 991: note = X can be any amino acid
  VARIANT 992: note = X can be any amino acid
  VARIANT 994: note = X can be any amino acid except P or G
  VARIANT 995: note = X can be any amino acid except P or G
  VARIANT 996: note = X can be any amino acid except P or G
  VARIANT 997: note = X can be any amino acid except P or G
  VARIANT 999: note = X can be any amino acid
  VARIANT 1000: note = X can be any amino acid
  VARIANT 1001: note = X can be any amino acid
  VARIANT 1003: note = X can be any amino acid except P or G
  VARIANT 1004: note = X can be any amino acid except P or G
  VARIANT 1005: note = X can be any amino acid except P or G
  VARIANT 1006: note = X can be any amino acid except P or G
  VARIANT 1008: note = X can be any amino acid
  VARIANT 1009: note = X can be any amino acid
  VARIANT 1010: note = X can be any amino acid
  VARIANT 1012: note = X can be any amino acid except P or G
  VARIANT 1013: note = X can be any amino acid except P or G
  VARIANT 1014: note = X can be any amino acid except P or G
  VARIANT 1015: note = X can be any amino acid except P or G
  VARIANT 1017: note = X can be any amino acid
  VARIANT 1018: note = X can be any amino acid
  VARIANT 1019: note = X can be any amino acid
  VARIANT 1021: note = X can be any amino acid except P or G
  VARIANT 1022: note = X can be any amino acid except P or G
  VARIANT 1023: note = X can be any amino acid except P or G
  VARIANT 1024: note = X can be any amino acid except P or G
  VARIANT 1026: note = X can be any amino acid
  VARIANT 1027: note = X can be any amino acid
  VARIANT 1028: note = X can be any amino acid
  VARIANT 1030: note = X can be any amino acid except P or G
  VARIANT 1031: note = X can be any amino acid except P or G
  VARIANT 1032: note = X can be any amino acid except P or G
  VARIANT 1033: note = X can be any amino acid except P or G
  VARIANT 1035: note = X can be any amino acid
  VARIANT 1036: note = X can be any amino acid
  VARIANT 1037: note = X can be any amino acid
  VARIANT 1039: note = X can be any amino acid except P or G
  VARIANT 1040: note = X can be any amino acid except P or G
  VARIANT 1041: note = X can be any amino acid except P or G
  VARIANT 1042: note = X can be any amino acid except P or G
  VARIANT 1044: note = X can be any amino acid
  VARIANT 1045: note = X can be any amino acid
  VARIANT 1046: note = X can be any amino acid
  VARIANT 1048: note = X can be any amino acid except P or G
  VARIANT 1049: note = X can be any amino acid except P or G
  VARIANT 1050: note = X can be any amino acid except P or G
  VARIANT 1051: note = X can be any amino acid except P or G
  VARIANT 1053: note = X can be any amino acid
  VARIANT 1054: note = X can be any amino acid
  VARIANT 1055: note = X can be any amino acid
  VARIANT 1057: note = X can be any amino acid except P or G
  VARIANT 1058: note = X can be any amino acid except P or G
  VARIANT 1059: note = X can be any amino acid except P or G
  VARIANT 1060: note = X can be any amino acid except P or G
  VARIANT 1062: note = X can be any amino acid
  VARIANT 1063: note = X can be any amino acid
  VARIANT 1064: note = X can be any amino acid
  VARIANT 1066: note = X can be any amino acid except P or G
  VARIANT 1067: note = X can be any amino acid except P or G
  VARIANT 1068: note = X can be any amino acid except P or G
  VARIANT 1069: note = X can be any amino acid except P or G
  VARIANT 1071: note = X can be any amino acid
  VARIANT 1072: note = X can be any amino acid
  VARIANT 1073: note = X can be any amino acid
  VARIANT 1075: note = X can be any amino acid except P or G
  VARIANT 1076: note = X can be any amino acid except P or G
  VARIANT 1077: note = X can be any amino acid except P or G
  VARIANT 1078: note = X can be any amino acid except P or G
  VARIANT 1080: note = X can be any amino acid
  VARIANT 1081: note = X can be any amino acid
  VARIANT 1082: note = X can be any amino acid
  VARIANT 1084: note = X can be any amino acid except P or G
  VARIANT 1085: note = X can be any amino acid except P or G
  VARIANT 1086: note = X can be any amino acid except P or G
  VARIANT 1087: note = X can be any amino acid except P or G
  VARIANT 1089: note = X can be any amino acid
  VARIANT 1090: note = X can be any amino acid
  VARIANT 1091: note = X can be any amino acid
  VARIANT 1093: note = X can be any amino acid except P or G
  VARIANT 1094: note = X can be any amino acid except P or G
  VARIANT 1095: note = X can be any amino acid except P or G
  VARIANT 1096: note = X can be any amino acid except P or G
  VARIANT 1098: note = X can be any amino acid
  VARIANT 1099: note = X can be any amino acid
  VARIANT 1100: note = X can be any amino acid
  VARIANT 1102: note = X can be any amino acid except P or G
  VARIANT 1103: note = X can be any amino acid except P or G
  VARIANT 1104: note = X can be any amino acid except P or G
  VARIANT 1105: note = X can be any amino acid except P or G
  VARIANT 1107: note = X can be any amino acid
  VARIANT 1108: note = X can be any amino acid
  VARIANT 1109: note = X can be any amino acid
  VARIANT 1111: note = X can be any amino acid except P or G
  VARIANT 1112: note = X can be any amino acid except P or G
  VARIANT 1113: note = X can be any amino acid except P or G
  VARIANT 1114: note = X can be any amino acid except P or G
  VARIANT 1116: note = X can be any amino acid
  VARIANT 1117: note = X can be any amino acid
  VARIANT 1118: note = X can be any amino acid
  VARIANT 1120: note = X can be any amino acid except P or G
  VARIANT 1121: note = X can be any amino acid except P or G
  VARIANT 1122: note = X can be any amino acid except P or G
  VARIANT 1123: note = X can be any amino acid except P or G
  VARIANT 1125: note = X can be any amino acid
  VARIANT 1126: note = X can be any amino acid
  VARIANT 1127: note = X can be any amino acid
  VARIANT 1129: note = X can be any amino acid except P or G
  VARIANT 1130: note = X can be any amino acid except P or G
  VARIANT 1131: note = X can be any amino acid except P or G
  VARIANT 1132: note = X can be any amino acid except P or G
  VARIANT 1134: note = X can be any amino acid
  VARIANT 1135: note = X can be any amino acid
  VARIANT 1136: note = X can be any amino acid
  VARIANT 1138: note = X can be any amino acid except P or G
  VARIANT 1139: note = X can be any amino acid except P or G
  VARIANT 1140: note = X can be any amino acid except P or G
  VARIANT 1141: note = X can be any amino acid except P or G
  VARIANT 1143: note = X can be any amino acid
  VARIANT 1144: note = X can be any amino acid
  VARIANT 1145: note = X can be any amino acid
  VARIANT 1147: note = X can be any amino acid except P or G
  VARIANT 1148: note = X can be any amino acid except P or G
  VARIANT 1149: note = X can be any amino acid except P or G
  VARIANT 1150: note = X can be any amino acid except P or G
  VARIANT 1152: note = X can be any amino acid
  VARIANT 1153: note = X can be any amino acid
  VARIANT 1154: note = X can be any amino acid
  VARIANT 1156: note = X can be any amino acid except P or G
  VARIANT 1157: note = X can be any amino acid except P or G
  VARIANT 1158: note = X can be any amino acid except P or G
  VARIANT 1159: note = X can be any amino acid except P or G
  VARIANT 1161: note = X can be any amino acid
  VARIANT 1162: note = X can be any amino acid
  VARIANT 1163: note = X can be any amino acid
  VARIANT 1165: note = X can be any amino acid except P or G
  VARIANT 1166: note = X can be any amino acid except P or G
  VARIANT 1167: note = X can be any amino acid except P or G
  VARIANT 1168: note = X can be any amino acid except P or G
  VARIANT 1170: note = X can be any amino acid
  VARIANT 1171: note = X can be any amino acid
  VARIANT 1172: note = X can be any amino acid
  VARIANT 1174: note = X can be any amino acid except P or G
  VARIANT 1175: note = X can be any amino acid except P or G
  VARIANT 1176: note = X can be any amino acid except P or G
  VARIANT 1177: note = X can be any amino acid except P or G
  VARIANT 1179: note = X can be any amino acid
  VARIANT 1180: note = X can be any amino acid
  VARIANT 1181: note = X can be any amino acid
  VARIANT 1183: note = X can be any amino acid except P or G
  VARIANT 1184: note = X can be any amino acid except P or G
  VARIANT 1185: note = X can be any amino acid except P or G
  VARIANT 1186: note = X can be any amino acid except P or G
  VARIANT 1188: note = X can be any amino acid
  VARIANT 1189: note = X can be any amino acid
  VARIANT 1190: note = X can be any amino acid
  VARIANT 1192: note = X can be any amino acid except P or G
  VARIANT 1193: note = X can be any amino acid except P or G
  VARIANT 1194: note = X can be any amino acid except P or G
  VARIANT 1195: note = X can be any amino acid except P or G
  VARIANT 1197: note = X can be any amino acid
  VARIANT 1198: note = X can be any amino acid
  VARIANT 1199: note = X can be any amino acid
  VARIANT 1201: note = X can be any amino acid except P or G
  VARIANT 1202: note = X can be any amino acid except P or G
  VARIANT 1203: note = X can be any amino acid except P or G
  VARIANT 1204: note = X can be any amino acid except P or G
  VARIANT 1206: note = X can be any amino acid
  VARIANT 1207: note = X can be any amino acid
  VARIANT 1208: note = X can be any amino acid
  VARIANT 1210: note = X can be any amino acid except P or G
  VARIANT 1211: note = X can be any amino acid except P or G
  VARIANT 1212: note = X can be any amino acid except P or G
  VARIANT 1213: note = X can be any amino acid except P or G
  VARIANT 1215: note = X can be any amino acid
  VARIANT 1216: note = X can be any amino acid
  VARIANT 1217: note = X can be any amino acid
  VARIANT 1219: note = X can be any amino acid except P or G
  VARIANT 1220: note = X can be any amino acid except P or G
  VARIANT 1221: note = X can be any amino acid except P or G
  VARIANT 1222: note = X can be any amino acid except P or G
  VARIANT 1224: note = X can be any amino acid
  VARIANT 1225: note = X can be any amino acid
  VARIANT 1226: note = X can be any amino acid
  VARIANT 1228: note = X can be any amino acid except P or G
  VARIANT 1229: note = X can be any amino acid except P or G
  VARIANT 1230: note = X can be any amino acid except P or G
  VARIANT 1231: note = X can be any amino acid except P or G
  VARIANT 1233: note = X can be any amino acid
  VARIANT 1234: note = X can be any amino acid
  VARIANT 1235: note = X can be any amino acid
  VARIANT 1237: note = X can be any amino acid except P or G
  VARIANT 1238: note = X can be any amino acid except P or G
  VARIANT 1239: note = X can be any amino acid except P or G
  VARIANT 1240: note = X can be any amino acid except P or G
  VARIANT 1242: note = X can be any amino acid
  VARIANT 1243: note = X can be any amino acid
  VARIANT 1244: note = X can be any amino acid
  VARIANT 1246: note = X can be any amino acid except P or G
  VARIANT 1247: note = X can be any amino acid except P or G
  VARIANT 1248: note = X can be any amino acid except P or G
  VARIANT 1249: note = X can be any amino acid except P or G
  VARIANT 1251: note = X can be any amino acid
  VARIANT 1252: note = X can be any amino acid
  VARIANT 1253: note = X can be any amino acid
  VARIANT 1255: note = X can be any amino acid except P or G
  VARIANT 1256: note = X can be any amino acid except P or G
  VARIANT 1257: note = X can be any amino acid except P or G
  VARIANT 1258: note = X can be any amino acid except P or G
  VARIANT 1260: note = X can be any amino acid
  VARIANT 1261: note = X can be any amino acid
  VARIANT 1262: note = X can be any amino acid
  VARIANT 1264: note = X can be any amino acid except P or G
  VARIANT 1265: note = X can be any amino acid except P or G
  VARIANT 1266: note = X can be any amino acid except P or G
  VARIANT 1267: note = X can be any amino acid except P or G
  VARIANT 1269: note = X can be any amino acid
  VARIANT 1270: note = X can be any amino acid
  VARIANT 1271: note = X can be any amino acid
  VARIANT 1273: note = X can be any amino acid except P or G
  VARIANT 1274: note = X can be any amino acid except P or G
  VARIANT 1275: note = X can be any amino acid except P or G
  VARIANT 1276: note = X can be any amino acid except P or G
  VARIANT 1278: note = X can be any amino acid
  VARIANT 1279: note = X can be any amino acid
  VARIANT 1280: note = X can be any amino acid
  VARIANT 1282: note = X can be any amino acid except P or G
  VARIANT 1283: note = X can be any amino acid except P or G
  VARIANT 1284: note = X can be any amino acid except P or G
  VARIANT 1285: note = X can be any amino acid except P or G
  VARIANT 1287: note = X can be any amino acid
  VARIANT 1288: note = X can be any amino acid
  VARIANT 1289: note = X can be any amino acid
  VARIANT 1291: note = X can be any amino acid except P or G
  VARIANT 1292: note = X can be any amino acid except P or G
  VARIANT 1293: note = X can be any amino acid except P or G
  VARIANT 1294: note = X can be any amino acid except P or G
  VARIANT 1296: note = X can be any amino acid
  VARIANT 1297: note = X can be any amino acid
  VARIANT 1298: note = X can be any amino acid
  VARIANT 1300: note = X can be any amino acid except P or G
  VARIANT 1301: note = X can be any amino acid except P or G
  VARIANT 1302: note = X can be any amino acid except P or G
  VARIANT 1303: note = X can be any amino acid except P or G
  VARIANT 1305: note = X can be any amino acid
  VARIANT 1306: note = X can be any amino acid
  VARIANT 1307: note = X can be any amino acid
  VARIANT 1309: note = X can be any amino acid except P or G
  VARIANT 1310: note = X can be any amino acid except P or G
  VARIANT 1311: note = X can be any amino acid except P or G
  VARIANT 1312: note = X can be any amino acid except P or G
  VARIANT 1314: note = X can be any amino acid
  VARIANT 1315: note = X can be any amino acid
  VARIANT 1316: note = X can be any amino acid
  VARIANT 1318: note = X can be any amino acid except P or G
  VARIANT 1319: note = X can be any amino acid except P or G
  VARIANT 1320: note = X can be any amino acid except P or G
  VARIANT 1321: note = X can be any amino acid except P or G
  VARIANT 1323: note = X can be any amino acid
  VARIANT 1324: note = X can be any amino acid
  VARIANT 1325: note = X can be any amino acid
  VARIANT 1327: note = X can be any amino acid except P or G
  VARIANT 1328: note = X can be any amino acid except P or G
  VARIANT 1329: note = X can be any amino acid except P or G
  VARIANT 1330: note = X can be any amino acid except P or G
  VARIANT 1332: note = X can be any amino acid
  VARIANT 1333: note = X can be any amino acid
  VARIANT 1334: note = X can be any amino acid
  VARIANT 1336: note = X can be any amino acid except P or G
  VARIANT 1337: note = X can be any amino acid except P or G
  VARIANT 1338: note = X can be any amino acid except P or G
  VARIANT 1339: note = X can be any amino acid except P or G
  VARIANT 1341: note = X can be any amino acid
  VARIANT 1342: note = X can be any amino acid
  VARIANT 1343: note = X can be any amino acid
  VARIANT 1345: note = X can be any amino acid except P or G
  VARIANT 1346: note = X can be any amino acid except P or G
  VARIANT 1347: note = X can be any amino acid except P or G
  VARIANT 1348: note = X can be any amino acid except P or G
  VARIANT 1350: note = X can be any amino acid
  VARIANT 1351: note = X can be any amino acid
  VARIANT 1352: note = X can be any amino acid
  VARIANT 1354: note = X can be any amino acid except P or G
  VARIANT 1355: note = X can be any amino acid except P or G
  VARIANT 1356: note = X can be any amino acid except P or G
  VARIANT 1357: note = X can be any amino acid except P or G
  VARIANT 1359: note = X can be any amino acid
  VARIANT 1360: note = X can be any amino acid
  VARIANT 1361: note = X can be any amino acid
  VARIANT 1363: note = X can be any amino acid except P or G
  VARIANT 1364: note = X can be any amino acid except P or G
  VARIANT 1365: note = X can be any amino acid except P or G
  VARIANT 1366: note = X can be any amino acid except P or G
  VARIANT 1368: note = X can be any amino acid
  VARIANT 1369: note = X can be any amino acid
  VARIANT 1370: note = X can be any amino acid
  VARIANT 1372: note = X can be any amino acid except P or G
  VARIANT 1373: note = X can be any amino acid except P or G
  VARIANT 1374: note = X can be any amino acid except P or G
  VARIANT 1375: note = X can be any amino acid except P or G
  VARIANT 1377: note = X can be any amino acid
  VARIANT 1378: note = X can be any amino acid
  VARIANT 1379: note = X can be any amino acid
  VARIANT 1381: note = X can be any amino acid except P or G
  VARIANT 1382: note = X can be any amino acid except P or G
  VARIANT 1383: note = X can be any amino acid except P or G
  VARIANT 1384: note = X can be any amino acid except P or G
  VARIANT 1386: note = X can be any amino acid
  VARIANT 1387: note = X can be any amino acid
  VARIANT 1388: note = X can be any amino acid
  VARIANT 1390: note = X can be any amino acid except P or G
  VARIANT 1391: note = X can be any amino acid except P or G
  VARIANT 1392: note = X can be any amino acid except P or G
  VARIANT 1393: note = X can be any amino acid except P or G
  VARIANT 1395: note = X can be any amino acid
  VARIANT 1396: note = X can be any amino acid
  VARIANT 1397: note = X can be any amino acid
  VARIANT 1399: note = X can be any amino acid except P or G
  VARIANT 1400: note = X can be any amino acid except P or G
  VARIANT 1401: note = X can be any amino acid except P or G
  VARIANT 1402: note = X can be any amino acid except P or G
  VARIANT 1404: note = X can be any amino acid
  VARIANT 1405: note = X can be any amino acid
  VARIANT 1406: note = X can be any amino acid
  VARIANT 1408: note = X can be any amino acid except P or G
  VARIANT 1409: note = X can be any amino acid except P or G
  VARIANT 1410: note = X can be any amino acid except P or G
  VARIANT 1411: note = X can be any amino acid except P or G
  VARIANT 1413: note = X can be any amino acid
  VARIANT 1414: note = X can be any amino acid
  VARIANT 1415: note = X can be any amino acid
  VARIANT 1417: note = X can be any amino acid except P or G
  VARIANT 1418: note = X can be any amino acid except P or G
  VARIANT 1419: note = X can be any amino acid except P or G
  VARIANT 1420: note = X can be any amino acid except P or G
  VARIANT 1422: note = X can be any amino acid
  VARIANT 1423: note = X can be any amino acid
  VARIANT 1424: note = X can be any amino acid
  VARIANT 1426: note = X can be any amino acid except P or G
  VARIANT 1427: note = X can be any amino acid except P or G
  VARIANT 1428: note = X can be any amino acid except P or G
  VARIANT 1429: note = X can be any amino acid except P or G
  VARIANT 1431: note = X can be any amino acid
  VARIANT 1432: note = X can be any amino acid
  VARIANT 1433: note = X can be any amino acid
  VARIANT 1435: note = X can be any amino acid except P or G
  VARIANT 1436: note = X can be any amino acid except P or G
  VARIANT 1437: note = X can be any amino acid except P or G
  VARIANT 1438: note = X can be any amino acid except P or G
  VARIANT 1440: note = X can be any amino acid
XXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGX

SEQ ID NO: 58 - protein, 960 aa, synthetic construct
  REGION 1..960: note = elastin-like polypeptide
  REPEAT 1..6: note = single repeat of (XXPXGX)m where m=10-160
  VARIANT 61..960: note = up to 150 copies of (XXPXGX) can be deleted
  SITE 1: note = X can be any amino acid
  SITE 2: note = X can be any amino acid
  SITE 4: note = X can be any amino acid except P or G
  SITE 6: note = X can be any amino acid
  SITE 7: note = X can be any amino acid
  SITE 8: note = X can be any amino acid
  SITE 10: note = X can be any amino acid except P or G
  SITE 12: note = X can be any amino acid
  SITE 13: note = X can be any amino acid
  SITE 14: note = X can be any amino acid
  SITE 16: note = X can be any amino acid except P or G
  SITE 18: note = X can be any amino acid
  SITE 19: note = X can be any amino acid
  SITE 20: note = X can be any amino acid
  SITE 22: note = X can be any amino acid except P or G
  SITE 24: note = X can be any amino acid
  SITE 25: note = X can be any amino acid
  SITE 26: note = X can be any amino acid
  SITE 28: note = X can be any amino acid except P or G
  SITE 30: note = X can be any amino acid
  SITE 31: note = X can be any amino acid
  SITE 32: note = X can be any amino acid
  SITE 34: note = X can be any amino acid except P or G
  SITE 36: note = X can be any amino acid
  SITE 37: note = X can be any amino acid
  SITE 38: note = X can be any amino acid
  SITE 40: note = X can be any amino acid except P or G
  SITE 42: note = X can be any amino acid
  SITE 43: note = X can be any amino acid
  SITE 44: note = X can be any amino acid
  SITE 46: note = X can be any amino acid except P or G
  SITE 48: note = X can be any amino acid
  SITE 49: note = X can be any amino acid
  SITE 50: note = X can be any amino acid
  SITE 52: note = X can be any amino acid except P or G
  SITE 54: note = X can be any amino acid
  SITE 55: note = X can be any amino acid
  SITE 56: note = X can be any amino acid
  SITE 58: note = X can be any amino acid except P or G
  SITE 60: note = X can be any amino acid
  SITE 61: note = X can be any amino acid
  SITE 62: note = X can be any amino acid
  SITE 64: note = X can be any amino acid except P or G
  SITE 66: note = X can be any amino acid
  SITE 67: note = X can be any amino acid
  SITE 68: note = X can be any amino acid
  SITE 70: note = X can be any amino acid except P or G
  SITE 72: note = X can be any amino acid
  SITE 73: note = X can be any amino acid
  SITE 74: note = X can be any amino acid
  SITE 76: note = X can be any amino acid except P or G
  SITE 78: note = X can be any amino acid
  SITE 79: note = X can be any amino acid
  SITE 80: note = X can be any amino acid
  SITE 82: note = X can be any amino acid except P or G
  SITE 84: note = X can be any amino acid
  SITE 85: note = X can be any amino acid
  SITE 86: note = X can be any amino acid
  SITE 88: note = X can be any amino acid except P or G
  SITE 90: note = X can be any amino acid
  SITE 91: note = X can be any amino acid
  SITE 92: note = X can be any amino acid
  SITE 94: note = X can be any amino acid except P or G
  SITE 96: note = X can be any amino acid
  SITE 97: note = X can be any amino acid
  SITE 98: note = X can be any amino acid
  SITE 100: note = X can be any amino acid except P or G
  SITE 102: note = X can be any amino acid
  SITE 103: note = X can be any amino acid
  SITE 104: note = X can be any amino acid
  SITE 106: note = X can be any amino acid except P or G
  SITE 108: note = X can be any amino acid
  SITE 109: note = X can be any amino acid
  SITE 110: note = X can be any amino acid
  SITE 112: note = X can be any amino acid except P or G
  SITE 114: note = X can be any amino acid
  SITE 115: note = X can be any amino acid
  SITE 116: note = X can be any amino acid
  SITE 118: note = X can be any amino acid except P or G
  SITE 120: note = X can be any amino acid
  SITE 121: note = X can be any amino acid
  SITE 122: note = X can be any amino acid
  SITE 124: note = X can be any amino acid except P or G
  SITE 126: note = X can be any amino acid
  SITE 127: note = X can be any amino acid
  SITE 128: note = X can be any amino acid
  SITE 130: note = X can be any amino acid except P or G
  SITE 132: note = X can be any amino acid
  SITE 133: note = X can be any amino acid
  SITE 134: note = X can be any amino acid
  SITE 136: note = X can be any amino acid except P or G
  SITE 138: note = X can be any amino acid
  SITE 139: note = X can be any amino acid
  SITE 140: note = X can be any amino acid
  SITE 142: note = X can be any amino acid except P or G
  SITE 144: note = X can be any amino acid
  SITE 145: note = X can be any amino acid
  SITE 146: note = X can be any amino acid
  SITE 148: note = X can be any amino acid except P or G
  SITE 150: note = X can be any amino acid
  SITE 151: note = X can be any amino acid
  SITE 152: note = X can be any amino acid
  SITE 154: note = X can be any amino acid except P or G
  SITE 156: note = X can be any amino acid
  SITE 157: note = X can be any amino acid
  SITE 158: note = X can be any amino acid
  SITE 160: note = X can be any amino acid except P or G
  SITE 162: note = X can be any amino acid
  SITE 163: note = X can be any amino acid
  SITE 164: note = X can be any amino acid
  SITE 166: note = X can be any amino acid except P or G
  SITE 168: note = X can be any amino acid
  SITE 169: note = X can be any amino acid
  SITE 170: note = X can be any amino acid
  SITE 172: note = X can be any amino acid except P or G
  SITE 174: note = X can be any amino acid
  SITE 175: note = X can be any amino acid
  SITE 176: note = X can be any amino acid
  SITE 178: note = X can be any amino acid except P or G
  SITE 180: note = X can be any amino acid
  SITE 181: note = X can be any amino acid
  SITE 182: note = X can be any amino acid
  SITE 184: note = X can be any amino acid except P or G
  SITE 186: note = X can be any amino acid
  SITE 187: note = X can be any amino acid
  SITE 188: note = X can be any amino acid
  SITE 190: note = X can be any amino acid except P or G
  SITE 192: note = X can be any amino acid
  SITE 193: note = X can be any amino acid
  SITE 194: note = X can be any amino acid
  SITE 196: note = X can be any amino acid except P or G
  SITE 198: note = X can be any amino acid
  SITE 199: note = X can be any amino acid
  SITE 200: note = X can be any amino acid
  SITE 202: note = X can be any amino acid except P or G
  SITE 204: note = X can be any amino acid
  SITE 205: note = X can be any amino acid
  SITE 206: note = X can be any amino acid
  SITE 208: note = X can be any amino acid except P or G
  SITE 210: note = X can be any amino acid
  SITE 211: note = X can be any amino acid
  SITE 212: note = X can be any amino acid
  SITE 214: note = X can be any amino acid except P or G
  SITE 216: note = X can be any amino acid
  SITE 217: note = X can be any amino acid
  SITE 218: note = X can be any amino acid
  SITE 220: note = X can be any amino acid except P or G
  SITE 222: note = X can be any amino acid
  SITE 223: note = X can be any amino acid
  SITE 224: note = X can be any amino acid
  SITE 226: note = X can be any amino acid except P or G
  SITE 228: note = X can be any amino acid
  SITE 229: note = X can be any amino acid
  SITE 230: note = X can be any amino acid
  SITE 232: note = X can be any amino acid except P or G
  SITE 234: note = X can be any amino acid
  SITE 235: note = X can be any amino acid
  SITE 236: note = X can be any amino acid
  SITE 238: note = X can be any amino acid except P or G
  SITE 240: note = X can be any amino acid
  SITE 241: note = X can be any amino acid
  SITE 242: note = X can be any amino acid
  SITE 244: note = X can be any amino acid except P or G
  SITE 246: note = X can be any amino acid
  SITE 247: note = X can be any amino acid
  SITE 248: note = X can be any amino acid
  SITE 250: note = X can be any amino acid except P or G
  SITE 252: note = X can be any amino acid
  SITE 253: note = X can be any amino acid
  SITE 254: note = X can be any amino acid
  SITE 256: note = X can be any amino acid except P or G
  SITE 258: note = X can be any amino acid
  SITE 259: note = X can be any amino acid
  SITE 260: note = X can be any amino acid
  SITE 262: note = X can be any amino acid except P or G
  SITE 264: note = X can be any amino acid
  SITE 265: note = X can be any amino acid
  SITE 266: note = X can be any amino acid
  SITE 268: note = X can be any amino acid except P or G
  SITE 270: note = X can be any amino acid
  SITE 271: note = X can be any amino acid
  SITE 272: note = X can be any amino acid
  SITE 274: note = X can be any amino acid except P or G
  SITE 276: note = X can be any amino acid
  SITE 277: note = X can be any amino acid
  SITE 278: note = X can be any amino acid
  SITE 280: note = X can be any amino acid except P or G
  SITE 282: note = X can be any amino acid
  SITE 283: note = X can be any amino acid
  SITE 284: note = X can be any amino acid
  SITE 286: note = X can be any amino acid except P or G
  SITE 288: note = X can be any amino acid
  SITE 289: note = X can be any amino acid
  SITE 290: note = X can be any amino acid
  SITE 292: note = X can be any amino acid except P or G
  SITE 294: note = X can be any amino acid
  SITE 295: note = X can be any amino acid
  SITE 296: note = X can be any amino acid
  SITE 298: note = X can be any amino acid except P or G
  SITE 300: note = X can be any amino acid
  SITE 301: note = X can be any amino acid
  SITE 302: note = X can be any amino acid
  SITE 304: note = X can be any amino acid except P or G
  SITE 306: note = X can be any amino acid
  SITE 307: note = X can be any amino acid
  SITE 308: note = X can be any amino acid
  SITE 310: note = X can be any amino acid except P or G
  SITE 312: note = X can be any amino acid
  SITE 313: note = X can be any amino acid
  SITE 314: note = X can be any amino acid
  SITE 316: note = X can be any amino acid except P or G
  SITE 318: note = X can be any amino acid
  SITE 319: note = X can be any amino acid
  SITE 320: note = X can be any amino acid
  SITE 322: note = X can be any amino acid except P or G
  SITE 324: note = X can be any amino acid
  SITE 325: note = X can be any amino acid
  SITE 326: note = X can be any amino acid
  SITE 328: note = X can be any amino acid except P or G
  SITE 330: note = X can be any amino acid
  SITE 331: note = X can be any amino acid
  SITE 332: note = X can be any amino acid
  SITE 334: note = X can be any amino acid except P or G
  SITE 336: note = X can be any amino acid
  SITE 337: note = X can be any amino acid
  SITE 338: note = X can be any amino acid
  SITE 340: note = X can be any amino acid except P or G
  SITE 342: note = X can be any amino acid
  SITE 343: note = X can be any amino acid
  SITE 344: note = X can be any amino acid
  SITE 346: note = X can be any amino acid except P or G
  SITE 348: note = X can be any amino acid
  SITE 349: note = X can be any amino acid
  SITE 350: note = X can be any amino acid
  SITE 352: note = X can be any amino acid except P or G
  SITE 354: note = X can be any amino acid
  SITE 355: note = X can be any amino acid
  SITE 356: note = X can be any amino acid
  SITE 358: note = X can be any amino acid except P or G
  SITE 360: note = X can be any amino acid
  SITE 361: note = X can be any amino acid
  SITE 362: note = X can be any amino acid
  SITE 364: note = X can be any amino acid except P or G
  VARIANT 366: note = X can be any amino acid
  VARIANT 367: note = X can be any amino acid
  VARIANT 368: note = X can be any amino acid
  VARIANT 370: note = X can be any amino acid except P or G
  VARIANT 372: note = X can be any amino acid
  VARIANT 373: note = X can be any amino acid
  VARIANT 374: note = X can be any amino acid
  VARIANT 376: note = X can be any amino acid except P or G
  VARIANT 378: note = X can be any amino acid
  VARIANT 379: note = X can be any amino acid
  VARIANT 380: note = X can be any amino acid
  VARIANT 382: note = X can be any amino acid except P or G
  VARIANT 384: note = X can be any amino acid
  VARIANT 385: note = X can be any amino acid
  VARIANT 386: note = X can be any amino acid
  VARIANT 388: note = X can be any amino acid except P or G
  VARIANT 390: note = X can be any amino acid
  VARIANT 391: note = X can be any amino acid
  VARIANT 392: note = X can be any amino acid
  VARIANT 394: note = X can be any amino acid except P or G
  VARIANT 396: note = X can be any amino acid
  VARIANT 397: note = X can be any amino acid
  VARIANT 398: note = X can be any amino acid
  VARIANT 400: note = X can be any amino acid except P or G
  VARIANT 402: note = X can be any amino acid
  VARIANT 403: note = X can be any amino acid
  VARIANT 404: note = X can be any amino acid
  VARIANT 406: note = X can be any amino acid except P or G
  VARIANT 408: note = X can be any amino acid
  VARIANT 409: note = X can be any amino acid
  VARIANT 410: note = X can be any amino acid
  VARIANT 412: note = X can be any amino acid except P or G
  VARIANT 414: note = X can be any amino acid
  VARIANT 415: note = X can be any amino acid
  VARIANT 416: note = X can be any amino acid
  VARIANT 418: note = X can be any amino acid except P or G
  VARIANT 420: note = X can be any amino acid
  VARIANT 421: note = X can be any amino acid
  VARIANT 422: note = X can be any amino acid
  VARIANT 424: note = X can be any amino acid except P or G
  VARIANT 426: note = X can be any amino acid
  VARIANT 427: note = X can be any amino acid
  VARIANT 428: note = X can be any amino acid
  VARIANT 430: note = X can be any amino acid except P or G
  VARIANT 432: note = X can be any amino acid
  VARIANT 433: note = X can be any amino acid
  VARIANT 434: note = X can be any amino acid
  VARIANT 436: note = X can be any amino acid except P or G
  VARIANT 438: note = X can be any amino acid
  VARIANT 439: note = X can be any amino acid
  VARIANT 440: note = X can be any amino acid
  VARIANT 442: note = X can be any amino acid except P or G
  VARIANT 444: note = X can be any amino acid
  VARIANT 445: note = X can be any amino acid
  VARIANT 446: note = X can be any amino acid
  VARIANT 448: note = X can be any amino acid except P or G
  VARIANT 450: note = X can be any amino acid
  VARIANT 451: note = X can be any amino acid
  VARIANT 452: note = X can be any amino acid
  VARIANT 454: note = X can be any amino acid except P or G
  VARIANT 456: note = X can be any amino acid
  VARIANT 457: note = X can be any amino acid
  VARIANT 458: note = X can be any amino acid
  VARIANT 460: note = X can be any amino acid except P or G
  VARIANT 462: note = X can be any amino acid
  VARIANT 463: note = X can be any amino acid
  VARIANT 464: note = X can be any amino acid
  VARIANT 466: note = X can be any amino acid except P or G
  VARIANT 468: note = X can be any amino acid
  VARIANT 469: note = X can be any amino acid
  VARIANT 470: note = X can be any amino acid
  VARIANT 472: note = X can be any amino acid except P or G
  VARIANT 474: note = X can be any amino acid
  VARIANT 475: note = X can be any amino acid
  VARIANT 476: note = X can be any amino acid
  VARIANT 478: note = X can be any amino acid except P or G
  VARIANT 480: note = X can be any amino acid
  VARIANT 481: note = X can be any amino acid
  VARIANT 482: note = X can be any amino acid
  VARIANT 484: note = X can be any amino acid except P or G
  VARIANT 486: note = X can be any amino acid
  VARIANT 487: note = X can be any amino acid
  VARIANT 488: note = X can be any amino acid
  VARIANT 490: note = X can be any amino acid except P or G
  VARIANT 492: note = X can be any amino acid
  VARIANT 493: note = X can be any amino acid
  VARIANT 494: note = X can be any amino acid
  VARIANT 496: note = X can be any amino acid except P or G
  VARIANT 498: note = X can be any amino acid
  VARIANT 499: note = X can be any amino acid
  VARIANT 500: note = X can be any amino acid
  VARIANT 502: note = X can be any amino acid except P or G
  VARIANT 504: note = X can be any amino acid
  VARIANT 505: note = X can be any amino acid
  VARIANT 506: note = X can be any amino acid
  VARIANT 508: note = X can be any amino acid except P or G
  VARIANT 510: note = X can be any amino acid
  VARIANT 511: note = X can be any amino acid
  VARIANT 512: note = X can be any amino acid
  VARIANT 514: note = X can be any amino acid except P or G
  VARIANT 516: note = X can be any amino acid
  VARIANT 517: note = X can be any amino acid
  VARIANT 518: note = X can be any amino acid
  VARIANT 520: note = X can be any amino acid except P or G
  VARIANT 522: note = X can be any amino acid
  VARIANT 523: note = X can be any amino acid
  VARIANT 524: note = X can be any amino acid
  VARIANT 526: note = X can be any amino acid except P or G
  VARIANT 528: note = X can be any amino acid
  VARIANT 529: note = X can be any amino acid
  VARIANT 530: note = X can be any amino acid
  VARIANT 532: note = X can be any amino acid except P or G
  VARIANT 534: note = X can be any amino acid
  VARIANT 535: note = X can be any amino acid
  VARIANT 536: note = X can be any amino acid
  VARIANT 538: note = X can be any amino acid except P or G
  VARIANT 540: note = X can be any amino acid
  VARIANT 541: note = X can be any amino acid
  VARIANT 542: note = X can be any amino acid
  VARIANT 544: note = X can be any amino acid except P or G
  VARIANT 546: note = X can be any amino acid
  VARIANT 547: note = X can be any amino acid
  VARIANT 548: note = X can be any amino acid
  VARIANT 550: note = X can be any amino acid except P or G
  VARIANT 552: note = X can be any amino acid
  VARIANT 553: note = X can be any amino acid
  VARIANT 554: note = X can be any amino acid
  VARIANT 556: note = X can be any amino acid except P or G
  VARIANT 558: note = X can be any amino acid
  VARIANT 559: note = X can be any amino acid
  VARIANT 560: note = X can be any amino acid
  VARIANT 562: note = X can be any amino acid except P or G
  VARIANT 564: note = X can be any amino acid
  VARIANT 565: note = X can be any amino acid
  VARIANT 566: note = X can be any amino acid
  VARIANT 568: note = X can be any amino acid except P or G
  VARIANT 570: note = X can be any amino acid
  VARIANT 571: note = X can be any amino acid
  VARIANT 572: note = X can be any amino acid
  VARIANT 574: note = X can be any amino acid except P or G
  VARIANT 576: note = X can be any amino acid
  VARIANT 577: note = X can be any amino acid
  VARIANT 578: note = X can be any amino acid
  VARIANT 580: note = X can be any amino acid except P or G
  VARIANT 582: note = X can be any amino acid
  VARIANT 583: note = X can be any amino acid
  VARIANT 584: note = X can be any amino acid
  VARIANT 586: note = X can be any amino acid except P or G
  VARIANT 588: note = X can be any amino acid
  VARIANT 589: note = X can be any amino acid
  VARIANT 590: note = X can be any amino acid
  VARIANT 592: note = X can be any amino acid except P or G
  VARIANT 594: note = X can be any amino acid
  VARIANT 595: note = X can be any amino acid
  VARIANT 596: note = X can be any amino acid
  VARIANT 598: note = X can be any amino acid except P or G
  VARIANT 600: note = X can be any amino acid
  VARIANT 601: note = X can be any amino acid
  VARIANT 602: note = X can be any amino acid
  VARIANT 604: note = X can be any amino acid except P or G
  VARIANT 606: note = X can be any amino acid
  VARIANT 607: note = X can be any amino acid
  VARIANT 608: note = X can be any amino acid
  VARIANT 610: note = X can be any amino acid except P or G
  VARIANT 612: note = X can be any amino acid
  VARIANT 613: note = X can be any amino acid
  VARIANT 614: note = X can be any amino acid
  VARIANT 616: note = X can be any amino acid except P or G
  VARIANT 618: note = X can be any amino acid
  VARIANT 619: note = X can be any amino acid
  VARIANT 620: note = X can be any amino acid
  VARIANT 622: note = X can be any amino acid except P or G
  VARIANT 624: note = X can be any amino acid
  VARIANT 625: note = X can be any amino acid
  VARIANT 626: note = X can be any amino acid
  VARIANT 628: note = X can be any amino acid except P or G
  VARIANT 630: note = X can be any amino acid
  VARIANT 631: note = X can be any amino acid
  VARIANT 632: note = X can be any amino acid
  VARIANT 634: note = X can be any amino acid except P or G
  VARIANT 636: note = X can be any amino acid
  VARIANT 637: note = X can be any amino acid
  VARIANT 638: note = X can be any amino acid
  VARIANT 640: note = X can be any amino acid except P or G
  VARIANT 642: note = X can be any amino acid
  VARIANT 643: note = X can be any amino acid
  VARIANT 644: note = X can be any amino acid
  VARIANT 646: note = X can be any amino acid except P or G
  VARIANT 648: note = X can be any amino acid
  VARIANT 649: note = X can be any amino acid
  VARIANT 650: note = X can be any amino acid
  VARIANT 652: note = X can be any amino acid except P or G
  VARIANT 654: note = X can be any amino acid
  VARIANT 655: note = X can be any amino acid
  VARIANT 656: note = X can be any amino acid
  VARIANT 658: note = X can be any amino acid except P or G
  VARIANT 660: note = X can be any amino acid
  VARIANT 661: note = X can be any amino acid
  VARIANT 662: note = X can be any amino acid
  VARIANT 664: note = X can be any amino acid except P or G
  VARIANT 666: note = X can be any amino acid
  VARIANT 667: note = X can be any amino acid
  VARIANT 668: note = X can be any amino acid
  VARIANT 670: note = X can be any amino acid except P or G
  VARIANT 672: note = X can be any amino acid
  VARIANT 673: note = X can be any amino acid
  VARIANT 674: note = X can be any amino acid
  VARIANT 676: note = X can be any amino acid except P or G
  VARIANT 678: note = X can be any amino acid
  VARIANT 679: note = X can be any amino acid
  VARIANT 680: note = X can be any amino acid
  VARIANT 682: note = X can be any amino acid except P or G
  VARIANT 684: note = X can be any amino acid
  VARIANT 685: note = X can be any amino acid
  VARIANT 686: note = X can be any amino acid
  VARIANT 688: note = X can be any amino acid except P or G
  VARIANT 690: note = X can be any amino acid
  VARIANT 691: note = X can be any amino acid
  VARIANT 692: note = X can be any amino acid
  VARIANT 694: note = X can be any amino acid except P or G
  VARIANT 696: note = X can be any amino acid
  VARIANT 697: note = X can be any amino acid
  VARIANT 698: note = X can be any amino acid
  VARIANT 700: note = X can be any amino acid except P or G
  VARIANT 702: note = X can be any amino acid
  VARIANT 703: note = X can be any amino acid
  VARIANT 704: note = X can be any amino acid
  VARIANT 706: note = X can be any amino acid except P or G
  VARIANT 708: note = X can be any amino acid
  VARIANT 709: note = X can be any amino acid
  VARIANT 710: note = X can be any amino acid
  VARIANT 712: note = X can be any amino acid except P or G
  VARIANT 714: note = X can be any amino acid
  VARIANT 715: note = X can be any amino acid
  VARIANT 716: note = X can be any amino acid
  VARIANT 718: note = X can be any amino acid except P or G
  VARIANT 720: note = X can be any amino acid
  VARIANT 721: note = X can be any amino acid
  VARIANT 722: note = X can be any amino acid
  VARIANT 724: note = X can be any amino acid except P or G
  VARIANT 726: note = X can be any amino acid
  VARIANT 727: note = X can be any amino acid
  VARIANT 728: note = X can be any amino acid
  VARIANT 730: note = X can be any amino acid except P or G
  VARIANT 732: note = X can be any amino acid
  VARIANT 733: note = X can be any amino acid
  VARIANT 734: note = X can be any amino acid
  VARIANT 736: note = X can be any amino acid except P or G
  VARIANT 738: note = X can be any amino acid
  VARIANT 739: note = X can be any amino acid
  VARIANT 740: note = X can be any amino acid
  VARIANT 742: note = X can be any amino acid except P or G
  VARIANT 744: note = X can be any amino acid
  VARIANT 745: note = X can be any amino acid
  VARIANT 746: note = X can be any amino acid
  VARIANT 748: note = X can be any amino acid except P or G
  VARIANT 750: note = X can be any amino acid
  VARIANT 751: note = X can be any amino acid
  VARIANT 752: note = X can be any amino acid
  VARIANT 754: note = X can be any amino acid except P or G
  VARIANT 756: note = X can be any amino acid
  VARIANT 757: note = X can be any amino acid
  VARIANT 758: note = X can be any amino acid
  VARIANT 760: note = X can be any amino acid except P or G
  VARIANT 762: note = X can be any amino acid
  VARIANT 763: note = X can be any amino acid
  VARIANT 764: note = X can be any amino acid
  VARIANT 766: note = X can be any amino acid except P or G
  VARIANT 768: note = X can be any amino acid
  VARIANT 769: note = X can be any amino acid
  VARIANT 770: note = X can be any amino acid
  VARIANT 772: note = X can be any amino acid except P or G
  VARIANT 774: note = X can be any amino acid
  VARIANT 775: note = X can be any amino acid
  VARIANT 776: note = X can be any amino acid
  VARIANT 778: note = X can be any amino acid except P or G
  VARIANT 780: note = X can be any amino acid
  VARIANT 781: note = X can be any amino acid
  VARIANT 782: note = X can be any amino acid
  VARIANT 784: note = X can be any amino acid except P or G
  VARIANT 786: note = X can be any amino acid
  VARIANT 787: note = X can be any amino acid
  VARIANT 788: note = X can be any amino acid
  VARIANT 790: note = X can be any amino acid except P or G
  VARIANT 792: note = X can be any amino acid
  VARIANT 793: note = X can be any amino acid
  VARIANT 794: note = X can be any amino acid
  VARIANT 796: note = X can be any amino acid except P or G
  VARIANT 798: note = X can be any amino acid
  VARIANT 799: note = X can be any amino acid
  VARIANT 800: note = X can be any amino acid
  VARIANT 802: note = X can be any amino acid except P or G
  VARIANT 804: note = X can be any amino acid
  VARIANT 805: note = X can be any amino acid
  VARIANT 806: note = X can be any amino acid
  VARIANT 808: note = X can be any amino acid except P or G
  VARIANT 810: note = X can be any amino acid
  VARIANT 811: note = X can be any amino acid
  VARIANT 812: note = X can be any amino acid
  VARIANT 814: note = X can be any amino acid except P or G
  VARIANT 816: note = X can be any amino acid
  VARIANT 817: note = X can be any amino acid
  VARIANT 818: note = X can be any amino acid
  VARIANT 820: note = X can be any amino acid except P or G
  VARIANT 822: note = X can be any amino acid
  VARIANT 823: note = X can be any amino acid
  VARIANT 824: note = X can be any amino acid
  VARIANT 826: note = X can be any amino acid except P or G
  VARIANT 828: note = X can be any amino acid
  VARIANT 829: note = X can be any amino acid
  VARIANT 830: note = X can be any amino acid
  VARIANT 832: note = X can be any amino acid except P or G
  VARIANT 834: note = X can be any amino acid
  VARIANT 835: note = X can be any amino acid
  VARIANT 836: note = X can be any amino acid
  VARIANT 838: note = X can be any amino acid except P or G
  VARIANT 840: note = X can be any amino acid
  VARIANT 841: note = X can be any amino acid
  VARIANT 842: note = X can be any amino acid
  VARIANT 844: note = X can be any amino acid except P or G
  VARIANT 846: note = X can be any amino acid
  VARIANT 847: note = X can be any amino acid
  VARIANT 848: note = X can be any amino acid
  VARIANT 850: note = X can be any amino acid except P or G
  VARIANT 852: note = X can be any amino acid
  VARIANT 853: note = X can be any amino acid
  VARIANT 854: note = X can be any amino acid
  VARIANT 856: note = X can be any amino acid except P or G
  VARIANT 858: note = X can be any amino acid
  VARIANT 859: note = X can be any amino acid
  VARIANT 860: note = X can be any amino acid
  VARIANT 862: note = X can be any amino acid except P or G
  VARIANT 864: note = X can be any amino acid
  VARIANT 865: note = X can be any amino acid
  VARIANT 866: note = X can be any amino acid
  VARIANT 868: note = X can be any amino acid except P or G
  VARIANT 870: note = X can be any amino acid
  VARIANT 871: note = X can be any amino acid
  VARIANT 872: note = X can be any amino acid
  VARIANT 874: note = X can be any amino acid except P or G
  VARIANT 876: note = X can be any amino acid
  VARIANT 877: note = X can be any amino acid
  VARIANT 878: note = X can be any amino acid
  VARIANT 880: note = X can be any amino acid except P or G
  VARIANT 882: note = X can be any amino acid
  VARIANT 883: note = X can be any amino acid
  VARIANT 884: note = X can be any amino acid
  VARIANT 886: note = X can be any amino acid except P or G
  VARIANT 888: note = X can be any amino acid
  VARIANT 889: note = X can be any amino acid
  VARIANT 890: note = X can be any amino acid
  VARIANT 892: note = X can be any amino acid except P or G
  VARIANT 894: note = X can be any amino acid
  VARIANT 895: note = X can be any amino acid
  VARIANT 896: note = X can be any amino acid
  VARIANT 898: note = X can be any amino acid except P or G
  VARIANT 900: note = X can be any amino acid
  VARIANT 901: note = X can be any amino acid
  VARIANT 902: note = X can be any amino acid
  VARIANT 904: note = X can be any amino acid except P or G
  VARIANT 906: note = X can be any amino acid
  VARIANT 907: note = X can be any amino acid
  VARIANT 908: note = X can be any amino acid
  VARIANT 910: note = X can be any amino acid except P or G
  VARIANT 912: note = X can be any amino acid
  VARIANT 913: note = X can be any amino acid
  VARIANT 914: note = X can be any amino acid
  VARIANT 916: note = X can be any amino acid except P or G
  VARIANT 918: note = X can be any amino acid
  VARIANT 919: note = X can be any amino acid
  VARIANT 920: note = X can be any amino acid
  VARIANT 922: note = X can be any amino acid except P or G
  VARIANT 924: note = X can be any amino acid
  VARIANT 925: note = X can be any amino acid
  VARIANT 926: note = X can be any amino acid
  VARIANT 928: note = X can be any amino acid except P or G
  VARIANT 930: note = X can be any amino acid
  VARIANT 931: note = X can be any amino acid
  VARIANT 932: note = X can be any amino acid
  VARIANT 934: note = X can be any amino acid except P or G
  VARIANT 936: note = X can be any amino acid
  VARIANT 937: note = X can be any amino acid
  VARIANT 938: note = X can be any amino acid
  VARIANT 940: note = X can be any amino acid except P or G
  VARIANT 942: note = X can be any amino acid
  VARIANT 943: note = X can be any amino acid
  VARIANT 944: note = X can be any amino acid
  VARIANT 946: note = X can be any amino acid except P or G
  VARIANT 948: note = X can be any amino acid
  VARIANT 949: note = X can be any amino acid
  VARIANT 950: note = X can be any amino acid
  VARIANT 952: note = X can be any amino acid except P or G
  VARIANT 954: note = X can be any amino acid
  VARIANT 955: note = X can be any amino acid
  VARIANT 956: note = X can be any amino acid
  VARIANT 958: note = X can be any amino acid except P or G
  VARIANT 960: note = X can be any amino acid
XXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGX

SEQ ID NO: 59 - protein, 1120 aa, synthetic construct
  REGION 1..1120: note = elastin-like polypeptide
  REPEAT 1..7: note = single repeat of (XXPXXGX)m where m=10-160
  VARIANT 71..1120: note = up to 150 copies of (XXPXXGX) can be deleted
  VARIANT 1: note = X can be any amino acid
  VARIANT 2: note = X can be any amino acid
  VARIANT 4: note = X can be any amino acid except P or G
  VARIANT 5: note = X can be any amino acid except P or G
  VARIANT 7: note = X can be any amino acid
  VARIANT 8: note = X can be any amino acid
  VARIANT 9: note = X can be any amino acid
  VARIANT 11: note = X can be any amino acid except P or G
  VARIANT 12: note = X can be any amino acid except P or G
  VARIANT 14: note = X can be any amino acid
  VARIANT 15: note = X can be any amino acid
  VARIANT 16: note = X can be any amino acid
  VARIANT 18: note = X can be any amino acid except P or G
  VARIANT 19: note = X can be any amino acid except P or G
  VARIANT 21: note = X can be any amino acid
  VARIANT 22: note = X can be any amino acid
  VARIANT 23: note = X can be any amino acid
  VARIANT 25: note = X can be any amino acid except P or G
  VARIANT 26: note = X can be any amino acid except P or G
  VARIANT 28: note = X can be any amino acid
  VARIANT 29: note = X can be any amino acid
  VARIANT 30: note = X can be any amino acid
  VARIANT 32: note = X can be any amino acid except P or G
  VARIANT 33: note = X can be any amino acid except P or G
  VARIANT 35: note = X can be any amino acid
  VARIANT 36: note = X can be any amino acid
  VARIANT 37: note = X can be any amino acid
  VARIANT 39: note = X can be any amino acid except P or G
  VARIANT 40: note = X can be any amino acid except P or G
  VARIANT 42: note = X can be any amino acid
  VARIANT 43: note = X can be any amino acid
  VARIANT 44: note = X can be any amino acid
  VARIANT 46: note = X can be any amino acid except P or G
  VARIANT 47: note = X can be any amino acid except P or G
  VARIANT 49: note = X can be any amino acid
  VARIANT 50: note = X can be any amino acid
  VARIANT 51: note = X can be any amino acid
  VARIANT 53: note = X can be any amino acid except P or G
  VARIANT 54: note = X can be any amino acid except P or G
  VARIANT 56: note = X can be any amino acid
  VARIANT 57: note = X can be any amino acid
  VARIANT 58: note = X can be any amino acid
  VARIANT 60: note = X can be any amino acid except P or G
  VARIANT 61: note = X can be any amino acid except P or G
  VARIANT 63: note = X can be any amino acid
  VARIANT 64: note = X can be any amino acid
  VARIANT 65: note = X can be any amino acid
  VARIANT 67: note = X can be any amino acid except P or G
  VARIANT 68: note = X can be any amino acid except P or G
  VARIANT 70: note = X can be any amino acid
  VARIANT 71: note = X can be any amino acid
  VARIANT 72: note = X can be any amino acid
  VARIANT 74: note = X can be any amino acid except P or G
  VARIANT 75: note = X can be any amino acid except P or G
  VARIANT 77: note = X can be any amino acid
  VARIANT 78: note = X can be any amino acid
  VARIANT 79: note = X can be any amino acid
  VARIANT 81: note = X can be any amino acid except P or G
  VARIANT 82: note = X can be any amino acid except P or G
  VARIANT 84: note = X can be any amino acid
  VARIANT 85: note = X can be any amino acid
  VARIANT 86: note = X can be any amino acid
  VARIANT 88: note = X can be any amino acid except P or G
  VARIANT 89: note = X can be any amino acid except P or G
  VARIANT 91: note = X can be any amino acid
  VARIANT 92: note = X can be any amino acid
  VARIANT 93: note = X can be any amino acid
  VARIANT 95: note = X can be any amino acid except P or G
  VARIANT 96: note = X can be any amino acid except P or G
  VARIANT 98: note = X can be any amino acid
  VARIANT 99: note = X can be any amino acid
  VARIANT 100: note = X can be any amino acid
  VARIANT 102: note = X can be any amino acid except P or G
  VARIANT 103: note = X can be any amino acid except P or G
  VARIANT 105: note = X can be any amino acid
  VARIANT 106: note = X can be any amino acid
  VARIANT 107: note = X can be any amino acid
  VARIANT 109: note = X can be any amino acid except P or G
  VARIANT 110: note = X can be any amino acid except P or G
  VARIANT 112: note = X can be any amino acid
  VARIANT 113: note = X can be any amino acid
  VARIANT 114: note = X can be any amino acid
  VARIANT 116: note = X can be any amino acid except P or G
  VARIANT 117: note = X can be any amino acid except P or G
  VARIANT 119: note = X can be any amino acid
  VARIANT 120: note = X can be any amino acid
  VARIANT 121: note = X can be any amino acid
  VARIANT 123: note = X can be any amino acid except P or G
  VARIANT 124: note = X can be any amino acid except P or G
  VARIANT 126: note = X can be any amino acid
  VARIANT 127: note = X can be any amino acid
  VARIANT 128: note = X can be any amino acid
  VARIANT 130: note = X can be any amino acid except P or G
  VARIANT 131: note = X can be any amino acid except P or G
  VARIANT 133: note = X can be any amino acid
  VARIANT 134: note = X can be any amino acid
  VARIANT 135: note = X can be any amino acid
  VARIANT 137: note = X can be any amino acid except P or G
  VARIANT 138: note = X can be any amino acid except P or G
  VARIANT 140: note = X can be any amino acid
  VARIANT 141: note = X can be any amino acid
  VARIANT 142: note = X can be any amino acid
  VARIANT 144: note = X can be any amino acid except P or G
  VARIANT 145: note = X can be any amino acid except P or G
  VARIANT 147: note = X can be any amino acid
  VARIANT 148: note = X can be any amino acid
  VARIANT 149: note = X can be any amino acid
  VARIANT 151: note = X can be any amino acid except P or G
  VARIANT 152: note = X can be any amino acid except P or G
  VARIANT 154: note = X can be any amino acid
  VARIANT 155: note = X can be any amino acid
  VARIANT 156: note = X can be any amino acid
  VARIANT 158: note = X can be any amino acid except P or G
  VARIANT 159: note = X can be any amino acid except P or G
  VARIANT 161: note = X can be any amino acid
  VARIANT 162: note = X can be any amino acid
  VARIANT 163: note = X can be any amino acid
  VARIANT 165: note = X can be any amino acid except P or G
  VARIANT 166: note = X can be any amino acid except P or G
  VARIANT 168: note = X can be any amino acid
  VARIANT 169: note = X can be any amino acid
  VARIANT 170: note = X can be any amino acid
  VARIANT 172: note = X can be any amino acid except P or G
  VARIANT 173: note = X can be any amino acid except P or G
  VARIANT 175: note = X can be any amino acid
  VARIANT 176: note = X can be any amino acid
  VARIANT 177: note = X can be any amino acid
  VARIANT 179: note = X can be any amino acid except P or G
  VARIANT 180: note = X can be any amino acid except P or G
  VARIANT 182: note = X can be any amino acid
  VARIANT 183: note = X can be any amino acid
  VARIANT 184: note = X can be any amino acid
  VARIANT 186: note = X can be any amino acid except P or G
  VARIANT 187: note = X can be any amino acid except P or G
  VARIANT 189: note = X can be any amino acid
  VARIANT 190: note = X can be any amino acid
  VARIANT 191: note = X can be any amino acid
  VARIANT 193: note = X can be any amino acid except P or G
  VARIANT 194: note = X can be any amino acid except P or G
  VARIANT 196: note = X can be any amino acid
  VARIANT 197: note = X can be any amino acid
  VARIANT 198: note = X can be any amino acid
  VARIANT 200: note = X can be any amino acid except P or G
  VARIANT 201: note = X can be any amino acid except P or G
  VARIANT 203: note = X can be any amino acid
  VARIANT 204: note = X can be any amino acid
  VARIANT 205: note = X can be any amino acid
  VARIANT 207: note = X can be any amino acid except P or G
  VARIANT 208: note = X can be any amino acid except P or G
  VARIANT 210: note = X can be any amino acid
  VARIANT 211: note = X can be any amino acid
  VARIANT 212: note = X can be any amino acid
  VARIANT 214: note = X can be any amino acid except P or G
  VARIANT 215: note = X can be any amino acid except P or G
  VARIANT 217: note = X can be any amino acid
  VARIANT 218: note = X can be any amino acid
  VARIANT 219: note = X can be any amino acid
  VARIANT 221: note = X can be any amino acid except P or G
  VARIANT 222: note = X can be any amino acid except P or G
  VARIANT 224: note = X can be any amino acid
  VARIANT 225: note = X can be any amino acid
  VARIANT 226: note = X can be any amino acid
  VARIANT 228: note = X can be any amino acid except P or G
  VARIANT 229: note = X can be any amino acid except P or G
  VARIANT 231: note = X can be any amino acid
  VARIANT 232: note = X can be any amino acid
  VARIANT 233: note = X can be any amino acid
  VARIANT 235: note = X can be any amino acid except P or G
  VARIANT 236: note = X can be any amino acid except P or G
  VARIANT 238: note = X can be any amino acid
  VARIANT 239: note = X can be any amino acid
  VARIANT 240: note = X can be any amino acid
  VARIANT 242: note = X can be any amino acid except P or G
  VARIANT 243: note = X can be any amino acid except P or G
  VARIANT 245: note = X can be any amino acid
  VARIANT 246: note = X can be any amino acid
  VARIANT 247: note = X can be any amino acid
  VARIANT 249: note = X can be any amino acid except P or G
  VARIANT 250: note = X can be any amino acid except P or G
  VARIANT 252: note = X can be any amino acid
  VARIANT 253: note = X can be any amino acid
  VARIANT 254: note = X can be any amino acid
  VARIANT 256: note = X can be any amino acid except P or G
  VARIANT 257: note = X can be any amino acid except P or G
  VARIANT 259: note = X can be any amino acid
  VARIANT 260: note = X can be any amino acid
  VARIANT 261: note = X can be any amino acid
  VARIANT 263: note = X can be any amino acid except P or G
  VARIANT 264: note = X can be any amino acid except P or G
  VARIANT 266: note = X can be any amino acid
  VARIANT 267: note = X can be any amino acid
  VARIANT 268: note = X can be any amino acid
  VARIANT 270: note = X can be any amino acid except P or G
  VARIANT 271: note = X can be any amino acid except P or G
  VARIANT 273: note = X can be any amino acid
  VARIANT 274: note = X can be any amino acid
  VARIANT 275: note = X can be any amino acid
  VARIANT 277: note = X can be any amino acid except P or G
  VARIANT 278: note = X can be any amino acid except P or G
  VARIANT 280: note = X can be any amino acid
  VARIANT 281: note = X can be any amino acid
  VARIANT 282: note = X can be any amino acid
  VARIANT 284: note = X can be any amino acid except P or G
  VARIANT 285: note = X can be any amino acid except P or G
  VARIANT 287: note = X can be any amino acid
  VARIANT 288: note = X can be any amino acid
  VARIANT 289: note = X can be any amino acid
  VARIANT 291: note = X can be any amino acid except P or G
  VARIANT 292: note = X can be any amino acid except P or G
  VARIANT 294: note = X can be any amino acid
  VARIANT 295: note = X can be any amino acid
  VARIANT 296: note = X can be any amino acid
  VARIANT 298: note = X can be any amino acid except P or G
  VARIANT 299: note = X can be any amino acid except P or G
  VARIANT 301: note = X can be any amino acid
  VARIANT 302: note = X can be any amino acid
  VARIANT 303: note = X can be any amino acid
  VARIANT 305: note = X can be any amino acid except P or G
  VARIANT 306: note = X can be any amino acid except P or G
  VARIANT 308: note = X can be any amino acid
  VARIANT 309: note = X can be any amino acid
  VARIANT 310: note = X can be any amino acid
  VARIANT 312: note = X can be any amino acid except P or G
  VARIANT 313: note = X can be any amino acid except P or G
  VARIANT 315: note = X can be any amino acid
  VARIANT 316: note = X can be any amino acid
  VARIANT 317: note = X can be any amino acid
  VARIANT 319: note = X can be any amino acid except P or G
  VARIANT 320: note = X can be any amino acid except P or G
  VARIANT 322: note = X can be any amino acid
  VARIANT 323: note = X can be any amino acid
  VARIANT 324: note = X can be any amino acid
  VARIANT 326: note = X can be any amino acid except P or G
  VARIANT 327: note = X can be any amino acid except P or G
  VARIANT 329: note = X can be any amino acid
  VARIANT 330: note = X can be any amino acid
  VARIANT 331: note = X can be any amino acid
  VARIANT 333: note = X can be any amino acid except P or G
  VARIANT 334: note = X can be any amino acid except P or G
  VARIANT 336: note = X can be any amino acid
  VARIANT 337: note = X can be any amino acid
  VARIANT 338: note = X can be any amino acid
  VARIANT 340: note = X can be any amino acid except P or G
  VARIANT 341: note = X can be any amino acid except P or G
  VARIANT 343: note = X can be any amino acid
  VARIANT 344: note = X can be any amino acid
  VARIANT 345: note = X can be any amino acid
  VARIANT 347: note = X can be any amino acid except P or G
  VARIANT 348: note = X can be any amino acid except P or G
  VARIANT 350: note = X can be any amino acid
  VARIANT 351: note = X can be any amino acid
  VARIANT 352: note = X can be any amino acid
  VARIANT 354: note = X can be any amino acid except P or G
  VARIANT 355: note = X can be any amino acid except P or G
  VARIANT 357: note = X can be any amino acid
  VARIANT 358: note = X can be any amino acid
  VARIANT 359: note = X can be any amino acid
  VARIANT 361: note = X can be any amino acid except P or G
  VARIANT 362: note = X can be any amino acid except P or G
  VARIANT 364: note = X can be any amino acid
  VARIANT 365: note = X can be any amino acid
  VARIANT 366: note = X can be any amino acid
  VARIANT 368: note = X can be any amino acid except P or G
  VARIANT 369: note = X can be any amino acid except P or G
  VARIANT 371: note = X can be any amino acid
  VARIANT 372: note = X can be any amino acid
  VARIANT 373: note = X can be any amino acid
  VARIANT 375: note = X can be any amino acid except P or G
  VARIANT 376: note = X can be any amino acid except P or G
  VARIANT 378: note = X can be any amino acid
  VARIANT 379: note = X can be any amino acid
  VARIANT 380: note = X can be any amino acid
  VARIANT 382: note = X can be any amino acid except P or G
  VARIANT 383: note = X can be any amino acid except P or G
  VARIANT 385: note = X can be any amino acid
  VARIANT 386: note = X can be any amino acid
  VARIANT 387: note = X can be any amino acid
  VARIANT 389: note = X can be any amino acid except P or G
  VARIANT 390: note = X can be any amino acid except P or G
  VARIANT 392: note = X can be any amino acid
  VARIANT 393: note = X can be any amino acid
  VARIANT 394: note = X can be any amino acid
  VARIANT 396: note = X can be any amino acid except P or G
  VARIANT 397: note = X can be any amino acid except P or G
  VARIANT 399: note = X can be any amino acid
  VARIANT 400: note = X can be any amino acid
  VARIANT 401: note = X can be any amino acid
  VARIANT 403: note = X can be any amino acid except P or G
  VARIANT 404: note = X can be any amino acid except P or G
  VARIANT 406: note = X can be any amino acid
  VARIANT 407: note = X can be any amino acid
  VARIANT 408: note = X can be any amino acid
  VARIANT 410: note = X can be any amino acid except P or G
  VARIANT 411: note = X can be any amino acid except P or G
  VARIANT 413: note = X can be any amino acid
  VARIANT 414: note = X can be any amino acid
  VARIANT 415: note = X can be any amino acid
  VARIANT 417: note = X can be any amino acid except P or G
  VARIANT 418: note = X can be any amino acid except P or G
  VARIANT 420: note = X can be any amino acid
  VARIANT 421: note = X can be any amino acid
  VARIANT 422: note = X can be any amino acid
  VARIANT 424: note = X can be any amino acid except P or G
  VARIANT 425: note = X can be any amino acid except P or G
  VARIANT 427: note = X can be any amino acid
  VARIANT 428: note = X can be any amino acid
  VARIANT 429: note = X can be any amino acid
  VARIANT 431: note = X can be any amino acid except P or G
  VARIANT 432: note = X can be any amino acid except P or G
  VARIANT 434: note = X can be any amino acid
  VARIANT 435: note = X can be any amino acid
  VARIANT 436: note = X can be any amino acid
  VARIANT 438: note = X can be any amino acid except P or G
  VARIANT 439: note = X can be any amino acid except P or G
  VARIANT 441: note = X can be any amino acid
  VARIANT 442: note = X can be any amino acid
  VARIANT 443: note = X can be any amino acid
  VARIANT 445: note = X can be any amino acid except P or G
  VARIANT 446: note = X can be any amino acid except P or G
  VARIANT 448: note = X can be any amino acid
  VARIANT 449: note = X can be any amino acid
  VARIANT 450: note = X can be any amino acid
  VARIANT 452: note = X can be any amino acid except P or G
  VARIANT 453: note = X can be any amino acid except P or G
  VARIANT 455: note = X can be any amino acid
  VARIANT 456: note = X can be any amino acid
  VARIANT 457: note = X can be any amino acid
  VARIANT 459: note = X can be any amino acid except P or G
  VARIANT 460: note = X can be any amino acid except P or G
  VARIANT 462: note = X can be any amino acid
  VARIANT 463: note = X can be any amino acid
  VARIANT 464: note = X can be any amino acid
  VARIANT 466: note = X can be any amino acid except P or G
  VARIANT 467: note = X can be any amino acid except P or G
  VARIANT 469: note = X can be any amino acid
  VARIANT 470: note = X can be any amino acid
  VARIANT 471: note = X can be any amino acid
  VARIANT 473: note = X can be any amino acid except P or G
  VARIANT 474: note = X can be any amino acid except P or G
  VARIANT 476: note = X can be any amino acid
  VARIANT 477: note = X can be any amino acid
  VARIANT 478: note = X can be any amino acid
  VARIANT 480: note = X can be any amino acid except P or G
  VARIANT 481: note = X can be any amino acid except P or G
  VARIANT 483: note = X can be any amino acid
  VARIANT 484: note = X can be any amino acid
  VARIANT 485: note = X can be any amino acid
  VARIANT 487: note = X can be any amino acid except P or G
  VARIANT 488: note = X can be any amino acid except P or G
  VARIANT 490: note = X can be any amino acid
  VARIANT 491: note = X can be any amino acid
  VARIANT 492: note = X can be any amino acid
  VARIANT 494: note = X can be any amino acid except P or G
  VARIANT 495: note = X can be any amino acid except P or G
  VARIANT 497: note = X can be any amino acid
  VARIANT 498: note = X can be any amino acid
  VARIANT 499: note = X can be any amino acid
  VARIANT 501: note = X can be any amino acid except P or G
  VARIANT 502: note = X can be any amino acid except P or G
  VARIANT 504: note = X can be any amino acid
  VARIANT 505: note = X can be any amino acid
  VARIANT 506: note = X can be any amino acid
  VARIANT 508: note = X can be any amino acid except P or G
  VARIANT 509: note = X can be any amino acid except P or G
  VARIANT 511: note = X can be any amino acid
  VARIANT 512: note = X can be any amino acid
  VARIANT 513: note = X can be any amino acid
  VARIANT 515: note = X can be any amino acid except P or G
  VARIANT 516: note = X can be any amino acid except P or G
  VARIANT 518: note = X can be any amino acid
  VARIANT 519: note = X can be any amino acid
  VARIANT 520: note = X can be any amino acid
  VARIANT 522: note = X can be any amino acid except P or G
  VARIANT 523: note = X can be any amino acid except P or G
  VARIANT 525: note = X can be any amino acid
  VARIANT 526: note = X can be any amino acid
  VARIANT 527: note = X can be any amino acid
  VARIANT 529: note = X can be any amino acid except P or G
  VARIANT 530: note = X can be any amino acid except P or G
  VARIANT 532: note = X can be any amino acid
  VARIANT 533: note = X can be any amino acid
  VARIANT 534: note = X can be any amino acid
  VARIANT 536: note = X can be any amino acid except P or G
  VARIANT 537: note = X can be any amino acid except P or G
  VARIANT 539: note = X can be any amino acid
  VARIANT 540: note = X can be any amino acid
  VARIANT 541: note = X can be any amino acid
  VARIANT 543: note = X can be any amino acid except P or G
  VARIANT 544: note = X can be any amino acid except P or G
  VARIANT 546: note = X can be any amino acid
  VARIANT 547: note = X can be any amino acid
  VARIANT 548: note = X can be any amino acid
  VARIANT 550: note = X can be any amino acid except P or G
  VARIANT 551: note = X can be any amino acid except P or G
  VARIANT 553: note = X can be any amino acid
  VARIANT 554: note = X can be any amino acid
  VARIANT 555: note = X can be any amino acid
  VARIANT 557: note = X can be any amino acid except P or G
  VARIANT 558: note = X can be any amino acid except P or G
  VARIANT 560: note = X can be any amino acid
  VARIANT 561: note = X can be any amino acid
  VARIANT 562: note = X can be any amino acid
  VARIANT 564: note = X can be any amino acid except P or G
  VARIANT 565: note = X can be any amino acid except P or G
  VARIANT 567: note = X can be any amino acid
  VARIANT 568: note = X can be any amino acid
  VARIANT 569: note = X can be any amino acid
  VARIANT 571: note = X can be any amino acid except P or G
  VARIANT 572: note = X can be any amino acid except P or G
  VARIANT 574: note = X can be any amino acid
  VARIANT 575: note = X can be any amino acid
  VARIANT 576: note = X can be any amino acid
  VARIANT 578: note = X can be any amino acid except P or G
  VARIANT 579: note = X can be any amino acid except P or G
  VARIANT 581: note = X can be any amino acid
  VARIANT 582: note = X can be any amino acid
  VARIANT 583: note = X can be any amino acid
  VARIANT 585: note = X can be any amino acid except P or G
  VARIANT 586: note = X can be any amino acid except P or G
  VARIANT 588: note = X can be any amino acid
  VARIANT 589: note = X can be any amino acid
  VARIANT 590: note = X can be any amino acid
  VARIANT 592: note = X can be any amino acid except P or G
  VARIANT 593: note = X can be any amino acid except P or G
  VARIANT 595: note = X can be any amino acid
  VARIANT 596: note = X can be any amino acid
  VARIANT 597: note = X can be any amino acid
  VARIANT 599: note = X can be any amino acid except P or G
  VARIANT 600: note = X can be any amino acid except P or G
  VARIANT 602: note = X can be any amino acid
  VARIANT 603: note = X can be any amino acid
  VARIANT 604: note = X can be any amino acid
  VARIANT 606: note = X can be any amino acid except P or G
  VARIANT 607: note = X can be any amino acid except P or G
  VARIANT 609: note = X can be any amino acid
  VARIANT 610: note = X can be any amino acid
  VARIANT 611: note = X can be any amino acid
  VARIANT 613: note = X can be any amino acid except P or G
  VARIANT 614: note = X can be any amino acid except P or G
  VARIANT 616: note = X can be any amino acid
  VARIANT 617: note = X can be any amino acid
  VARIANT 618: note = X can be any amino acid
  VARIANT 620: note = X can be any amino acid except P or G
  VARIANT 621: note = X can be any amino acid except P or G
  VARIANT 623: note = X can be any amino acid
  VARIANT 624: note = X can be any amino acid
  VARIANT 625: note = X can be any amino acid
  VARIANT 627: note = X can be any amino acid except P or G
  VARIANT 628: note = X can be any amino acid except P or G
  VARIANT 630: note = X can be any amino acid
  VARIANT 631: note = X can be any amino acid
  VARIANT 632: note = X can be any amino acid
  VARIANT 634: note = X can be any amino acid except P or G
  VARIANT 635: note = X can be any amino acid except P or G
  VARIANT 637: note = X can be any amino acid
  VARIANT 638: note = X can be any amino acid
  VARIANT 639: note = X can be any amino acid
  VARIANT 641: note = X can be any amino acid except P or G
  VARIANT 642: note = X can be any amino acid except P or G
  VARIANT 644: note = X can be any amino acid
  VARIANT 645: note = X can be any amino acid
  VARIANT 646: note = X can be any amino acid
  VARIANT 648: note = X can be any amino acid except P or G
  VARIANT 649: note = X can be any amino acid except P or G
  VARIANT 651: note = X can be any amino acid
  VARIANT 652: note = X can be any amino acid
  VARIANT 653: note = X can be any amino acid
  VARIANT 655: note = X can be any amino acid except P or G
  VARIANT 656: note = X can be any amino acid except P or G
  VARIANT 658: note = X can be any amino acid
  VARIANT 659: note = X can be any amino acid
  VARIANT 660: note = X can be any amino acid
  VARIANT 662: note = X can be any amino acid except P or G
  VARIANT 663: note = X can be any amino acid except P or G
  VARIANT 665: note = X can be any amino acid
  VARIANT 666: note = X can be any amino acid
  VARIANT 667: note = X can be any amino acid
  VARIANT 669: note = X can be any amino acid except P or G
  VARIANT 670: note = X can be any amino acid except P or G
  VARIANT 672: note = X can be any amino acid
  VARIANT 673: note = X can be any amino acid
  VARIANT 674: note = X can be any amino acid
  VARIANT 676: note = X can be any amino acid except P or G
  VARIANT 677: note = X can be any amino acid except P or G
  VARIANT 679: note = X can be any amino acid
  VARIANT 680: note = X can be any amino acid
  VARIANT 681: note = X can be any amino acid
  VARIANT 683: note = X can be any amino acid except P or G
  VARIANT 684: note = X can be any amino acid except P or G
  VARIANT 686: note = X can be any amino acid
  VARIANT 687: note = X can be any amino acid
  VARIANT 688: note = X can be any amino acid
  VARIANT 690: note = X can be any amino acid except P or G
  VARIANT 691: note = X can be any amino acid except P or G
  VARIANT 693: note = X can be any amino acid
  VARIANT 694: note = X can be any amino acid
  VARIANT 695: note = X can be any amino acid
  VARIANT 697: note = X can be any amino acid except P or G
  VARIANT 698: note = X can be any amino acid except P or G
  VARIANT 700: note = X can be any amino acid
  VARIANT 701: note = X can be any amino acid
  VARIANT 702: note = X can be any amino acid
  VARIANT 704: note = X can be any amino acid except P or G
  VARIANT 705: note = X can be any amino acid except P or G
  VARIANT 707: note = X can be any amino acid
  VARIANT 708: note = X can be any amino acid
  VARIANT 709: note = X can be any amino acid
  VARIANT 711: note = X can be any amino acid except P or G
  VARIANT 712: note = X can be any amino acid except P or G
  VARIANT 714: note = X can be any amino acid
  VARIANT 715: note = X can be any amino acid
  VARIANT 716: note = X can be any amino acid
  VARIANT 718: note = X can be any amino acid except P or G
  VARIANT 719: note = X can be any amino acid except P or G
  VARIANT 721: note = X can be any amino acid
  VARIANT 722: note = X can be any amino acid
  VARIANT 723: note = X can be any amino acid
  VARIANT 725: note = X can be any amino acid except P or G
  VARIANT 726: note = X can be any amino acid except P or G
  VARIANT 728: note = X can be any amino acid
  VARIANT 729: note = X can be any amino acid
  VARIANT 730: note = X can be any amino acid
  VARIANT 732: note = X can be any amino acid except P or G
  VARIANT 733: note = X can be any amino acid except P or G
  VARIANT 735: note = X can be any amino acid
  VARIANT 736: note = X can be any amino acid
  VARIANT 737: note = X can be any amino acid
  VARIANT 739: note = X can be any amino acid except P or G
  VARIANT 740: note = X can be any amino acid except P or G
  VARIANT 742: note = X can be any amino acid
  VARIANT 743: note = X can be any amino acid
  VARIANT 744: note = X can be any amino acid
  VARIANT 746: note = X can be any amino acid except P or G
  VARIANT 747: note = X can be any amino acid except P or G
  VARIANT 749: note = X can be any amino acid
  VARIANT 750: note = X can be any amino acid
  VARIANT 751: note = X can be any amino acid
  VARIANT 753: note = X can be any amino acid except P or G
  VARIANT 754: note = X can be any amino acid except P or G
  VARIANT 756: note = X can be any amino acid
  VARIANT 757: note = X can be any amino acid
  VARIANT 758: note = X can be any amino acid
  VARIANT 760: note = X can be any amino acid except P or G
  VARIANT 761: note = X can be any amino acid except P or G
  VARIANT 763: note = X can be any amino acid
  VARIANT 764: note = X can be any amino acid
  VARIANT 765: note = X can be any amino acid
  VARIANT 767: note = X can be any amino acid except P or G
  VARIANT 768: note = X can be any amino acid except P or G
  VARIANT 770: note = X can be any amino acid
  VARIANT 771: note = X can be any amino acid
  VARIANT 772: note = X can be any amino acid
  VARIANT 774: note = X can be any amino acid except P or G
  VARIANT 775: note = X can be any amino acid except P or G
  VARIANT 777: note = X can be any amino acid
  VARIANT 778: note = X can be any amino acid
  VARIANT 779: note = X can be any amino acid
  VARIANT 781: note = X can be any amino acid except P or G
  VARIANT 782: note = X can be any amino acid except P or G
  VARIANT 784: note = X can be any amino acid
  VARIANT 785: note = X can be any amino acid
  VARIANT 786: note = X can be any amino acid
  VARIANT 788: note = X can be any amino acid except P or G
  VARIANT 789: note = X can be any amino acid except P or G
  VARIANT 791: note = X can be any amino acid
  VARIANT 792: note = X can be any amino acid
  VARIANT 793: note = X can be any amino acid
  VARIANT 795: note = X can be any amino acid except P or G
  VARIANT 796: note = X can be any amino acid except P or G
  VARIANT 798: note = X can be any amino acid
  VARIANT 799: note = X can be any amino acid
  VARIANT 800: note = X can be any amino acid
  VARIANT 802: note = X can be any amino acid except P or G
  VARIANT 803: note = X can be any amino acid except P or G
  VARIANT 805: note = X can be any amino acid
  VARIANT 806: note = X can be any amino acid
  VARIANT 807: note = X can be any amino acid
  VARIANT 809: note = X can be any amino acid except P or G
  VARIANT 810: note = X can be any amino acid except P or G
  VARIANT 812: note = X can be any amino acid
  VARIANT 813: note = X can be any amino acid
  VARIANT 814: note = X can be any amino acid
  VARIANT 816: note = X can be any amino acid except P or G
  VARIANT 817: note = X can be any amino acid except P or G
  VARIANT 819: note = X can be any amino acid
  VARIANT 820: note = X can be any amino acid
  VARIANT 821: note = X can be any amino acid
  VARIANT 823: note = X can be any amino acid except P or G
  VARIANT 824: note = X can be any amino acid except P or G
  VARIANT 826: note = X can be any amino acid
  VARIANT 827: note = X can be any amino acid
  VARIANT 828: note = X can be any amino acid
  VARIANT 830: note = X can be any amino acid except P or G
  VARIANT 831: note = X can be any amino acid except P or G
  VARIANT 833: note = X can be any amino acid
  VARIANT 834: note = X can be any amino acid
  VARIANT 835: note = X can be any amino acid
  VARIANT 837: note = X can be any amino acid except P or G
  VARIANT 838: note = X can be any amino acid except P or G
  VARIANT 840: note = X can be any amino acid
  VARIANT 841: note = X can be any amino acid
  VARIANT 842: note = X can be any amino acid
  VARIANT 844: note = X can be any amino acid except P or G
  VARIANT 845: note = X can be any amino acid except P or G
  VARIANT 847: note = X can be any amino acid
  VARIANT 848: note = X can be any amino acid
  VARIANT 849: note = X can be any amino acid
  VARIANT 851: note = X can be any amino acid except P or G
  VARIANT 852: note = X can be any amino acid except P or G
  VARIANT 854: note = X can be any amino acid
  VARIANT 855: note = X can be any amino acid
  VARIANT 856: note = X can be any amino acid
  VARIANT 858: note = X can be any amino acid except P or G
  VARIANT 859: note = X can be any amino acid except P or G
  VARIANT 861: note = X can be any amino acid
  VARIANT 862: note = X can be any amino acid
  VARIANT 863: note = X can be any amino acid
  VARIANT 865: note = X can be any amino acid except P or G
  VARIANT 866: note = X can be any amino acid except P or G
  VARIANT 868: note = X can be any amino acid
  VARIANT 869: note = X can be any amino acid
  VARIANT 870: note = X can be any amino acid
  VARIANT 872: note = X can be any amino acid except P or G
  VARIANT 873: note = X can be any amino acid except P or G
  VARIANT 875: note = X can be any amino acid
  VARIANT 876: note = X can be any amino acid
  VARIANT 877: note = X can be any amino acid
  VARIANT 879: note = X can be any amino acid except P or G
  VARIANT 880: note = X can be any amino acid except P or G
  VARIANT 882: note = X can be any amino acid
  VARIANT 883: note = X can be any amino acid
  VARIANT 884: note = X can be any amino acid
  VARIANT 886: note = X can be any amino acid except P or G
  VARIANT 887: note = X can be any amino acid except P or G
  VARIANT 889: note = X can be any amino acid
  VARIANT 890: note = X can be any amino acid
  VARIANT 891: note = X can be any amino acid
  VARIANT 893: note = X can be any amino acid except P or G
  VARIANT 894: note = X can be any amino acid except P or G
  VARIANT 896: note = X can be any amino acid
  VARIANT 897: note = X can be any amino acid
  VARIANT 898: note = X can be any amino acid
  VARIANT 900: note = X can be any amino acid except P or G
  VARIANT 901: note = X can be any amino acid except P or G
  VARIANT 903: note = X can be any amino acid
  VARIANT 904: note = X can be any amino acid
  VARIANT 905: note = X can be any amino acid
  VARIANT 907: note = X can be any amino acid except P or G
  VARIANT 908: note = X can be any amino acid except P or G
  VARIANT 910: note = X can be any amino acid
  VARIANT 911: note = X can be any amino acid
  VARIANT 912: note = X can be any amino acid
  VARIANT 914: note = X can be any amino acid except P or G
  VARIANT 915: note = X can be any amino acid except P or G
  VARIANT 917: note = X can be any amino acid
  VARIANT 918: note = X can be any amino acid
  VARIANT 919: note = X can be any amino acid
  VARIANT 921: note = X can be any amino acid except P or G
  VARIANT 922: note = X can be any amino acid except P or G
  VARIANT 924: note = X can be any amino acid
  VARIANT 925: note = X can be any amino acid
  VARIANT 926: note = X can be any amino acid
  VARIANT 928: note = X can be any amino acid except P or G
  VARIANT 929: note = X can be any amino acid except P or G
  VARIANT 931: note = X can be any amino acid
  VARIANT 932: note = X can be any amino acid
  VARIANT 933: note = X can be any amino acid
  VARIANT 935: note = X can be any amino acid except P or G
  VARIANT 936: note = X can be any amino acid except P or G
  VARIANT 938: note = X can be any amino acid
  VARIANT 939: note = X can be any amino acid
  VARIANT 940: note = X can be any amino acid
  VARIANT 942: note = X can be any amino acid except P or G
  VARIANT 943: note = X can be any amino acid except P or G
  VARIANT 945: note = X can be any amino acid
  VARIANT 946: note = X can be any amino acid
  VARIANT 947: note = X can be any amino acid
  VARIANT 949: note = X can be any amino acid except P or G
  VARIANT 950: note = X can be any amino acid except P or G
  VARIANT 952: note = X can be any amino acid
  VARIANT 953: note = X can be any amino acid
  VARIANT 954: note = X can be any amino acid
  VARIANT 956: note = X can be any amino acid except P or G
  VARIANT 957: note = X can be any amino acid except P or G
  VARIANT 959: note = X can be any amino acid
  VARIANT 960: note = X can be any amino acid
  VARIANT 961: note = X can be any amino acid
  VARIANT 963: note = X can be any amino acid except P or G
  VARIANT 964: note = X can be any amino acid except P or G
  VARIANT 966: note = X can be any amino acid
  VARIANT 967: note = X can be any amino acid
  VARIANT 968: note = X can be any amino acid
  VARIANT 970: note = X can be any amino acid except P or G
  VARIANT 971: note = X can be any amino acid except P or G
  VARIANT 973: note = X can be any amino acid
  VARIANT 974: note = X can be any amino acid
  VARIANT 975: note = X can be any amino acid
  VARIANT 977: note = X can be any amino acid except P or G
  VARIANT 978: note = X can be any amino acid except P or G
  VARIANT 980: note = X can be any amino acid
  VARIANT 981: note = X can be any amino acid
  VARIANT 982: note = X can be any amino acid
  VARIANT 984: note = X can be any amino acid except P or G
  VARIANT 985: note = X can be any amino acid except P or G
  VARIANT 987: note = X can be any amino acid
  VARIANT 988: note = X can be any amino acid
  VARIANT 989: note = X can be any amino acid
  VARIANT 991: note = X can be any amino acid except P or G
  VARIANT 992: note = X can be any amino acid except P or G
  VARIANT 994: note = X can be any amino acid
  VARIANT 995: note = X can be any amino acid
  VARIANT 996: note = X can be any amino acid
  VARIANT 998: note = X can be any amino acid except P or G
  VARIANT 999: note = X can be any amino acid except P or G
  VARIANT 1001: note = X can be any amino acid
  VARIANT 1002: note = X can be any amino acid
  VARIANT 1003: note = X can be any amino acid
  VARIANT 1005: note = X can be any amino acid except P or G
  VARIANT 1006: note = X can be any amino acid except P or G
  VARIANT 1008: note = X can be any amino acid
  VARIANT 1009: note = X can be any amino acid
  VARIANT 1010: note = X can be any amino acid
  VARIANT 1012: note = X can be any amino acid except P or G
  VARIANT 1013: note = X can be any amino acid except P or G
  VARIANT 1015: note = X can be any amino acid
  VARIANT 1016: note = X can be any amino acid
  VARIANT 1017: note = X can be any amino acid
  VARIANT 1019: note = X can be any amino acid except P or G
  VARIANT 1020: note = X can be any amino acid except P or G
  VARIANT 1022: note = X can be any amino acid
  VARIANT 1023: note = X can be any amino acid
  VARIANT 1024: note = X can be any amino acid
  VARIANT 1026: note = X can be any amino acid except P or G
  VARIANT 1027: note = X can be any amino acid except P or G
  VARIANT 1029: note = X can be any amino acid
  VARIANT 1030: note = X can be any amino acid
  VARIANT 1031: note = X can be any amino acid
  VARIANT 1033: note = X can be any amino acid except P or G
  VARIANT 1034: note = X can be any amino acid except P or G
  VARIANT 1036: note = X can be any amino acid
  VARIANT 1037: note = X can be any amino acid
  VARIANT 1038: note = X can be any amino acid
  VARIANT 1040: note = X can be any amino acid except P or G
  VARIANT 1041: note = X can be any amino acid except P or G
  VARIANT 1043: note = X can be any amino acid
  VARIANT 1044: note = X can be any amino acid
  VARIANT 1045: note = X can be any amino acid
  VARIANT 1047: note = X can be any amino acid except P or G
  VARIANT 1048: note = X can be any amino acid except P or G
  VARIANT 1050: note = X can be any amino acid
  VARIANT 1051: note = X can be any amino acid
  VARIANT 1052: note = X can be any amino acid
  VARIANT 1054: note = X can be any amino acid except P or G
  VARIANT 1055: note = X can be any amino acid except P or G
  VARIANT 1057: note = X can be any amino acid
  VARIANT 1058: note = X can be any amino acid
  VARIANT 1059: note = X can be any amino acid
  VARIANT 1061: note = X can be any amino acid except P or G
  VARIANT 1062: note = X can be any amino acid except P or G
  VARIANT 1064: note = X can be any amino acid
  VARIANT 1065: note = X can be any amino acid
  VARIANT 1066: note = X can be any amino acid
  VARIANT 1068: note = X can be any amino acid except P or G
  VARIANT 1069: note = X can be any amino acid except P or G
  VARIANT 1071: note = X can be any amino acid
  VARIANT 1072: note = X can be any amino acid
  VARIANT 1073: note = X can be any amino acid
  VARIANT 1075: note = X can be any amino acid except P or G
  VARIANT 1076: note = X can be any amino acid except P or G
  VARIANT 1078: note = X can be any amino acid
  VARIANT 1079: note = X can be any amino acid
  VARIANT 1080: note = X can be any amino acid
  VARIANT 1082: note = X can be any amino acid except P or G
  VARIANT 1083: note = X can be any amino acid except P or G
  VARIANT 1085: note = X can be any amino acid
  VARIANT 1086: note = X can be any amino acid
  VARIANT 1087: note = X can be any amino acid
  VARIANT 1089: note = X can be any amino acid except P or G
  VARIANT 1090: note = X can be any amino acid except P or G
  VARIANT 1092: note = X can be any amino acid
  VARIANT 1093: note = X can be any amino acid
  VARIANT 1094: note = X can be any amino acid
  VARIANT 1096: note = X can be any amino acid except P or G
  VARIANT 1097: note = X can be any amino acid except P or G
  VARIANT 1099: note = X can be any amino acid
  VARIANT 1100: note = X can be any amino acid
  VARIANT 1101: note = X can be any amino acid
  VARIANT 1103: note = X can be any amino acid except P or G
  VARIANT 1104: note = X can be any amino acid except P or G
  VARIANT 1106: note = X can be any amino acid
  VARIANT 1107: note = X can be any amino acid
  VARIANT 1108: note = X can be any amino acid
  VARIANT 1110: note = X can be any amino acid except P or G
  VARIANT 1111: note = X can be any amino acid except P or G
  VARIANT 1113: note = X can be any amino acid
  VARIANT 1114: note = X can be any amino acid
  VARIANT 1115: note = X can be any amino acid
  VARIANT 1117: note = X can be any amino acid except P or G
  VARIANT 1118: note = X can be any amino acid except P or G
  VARIANT 1120: note = X can be any amino acid
XXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGX

SEQ ID NO: 60 - protein, 1280 aa, synthetic construct
  REGION 1..1280: note = elastin-like polypeptide
  REPEAT 1..8: note = single repeat of (XXPXXXGX)m where m=10-160
  VARIANT 81..1250: note = up to 150 copies of (XXPXXXGX) can be deleted
  VARIANT 1: note = X can be any amino acid
  VARIANT 2: note = X can be any amino acid
  VARIANT 4: note = X can be any amino acid except P or G
  VARIANT 5: note = X can be any amino acid except P or G
  VARIANT 6: note = X can be any amino acid except P or G
  VARIANT 8: note = X can be any amino acid
  VARIANT 9: note = X can be any amino acid
  VARIANT 10: note = X can be any amino acid
  VARIANT 12: note = X can be any amino acid except P or G
  VARIANT 13: note = X can be any amino acid except P or G
  VARIANT 14: note = X can be any amino acid except P or G
  VARIANT 16: note = X can be any amino acid
  VARIANT 17: note = X can be any amino acid
  VARIANT 18: note = X can be any amino acid
  VARIANT 20: note = X can be any amino acid except P or G
  VARIANT 21: note = X can be any amino acid except P or G
  VARIANT 22: note = X can be any amino acid except P or G
  VARIANT 24: note = X can be any amino acid
  VARIANT 25: note = X can be any amino acid
  VARIANT 26: note = X can be any amino acid
  VARIANT 28: note = X can be any amino acid except P or G
  VARIANT 29: note = X can be any amino acid except P or G
  VARIANT 30: note = X can be any amino acid except P or G
  VARIANT 32: note = X can be any amino acid
  VARIANT 33: note = X can be any amino acid
  VARIANT 34: note = X can be any amino acid
  VARIANT 36: note = X can be any amino acid except P or G
  VARIANT 37: note = X can be any amino acid except P or G
  VARIANT 38: note = X can be any amino acid except P or G
  VARIANT 40: note = X can be any amino acid
  VARIANT 41: note = X can be any amino acid
  VARIANT 42: note = X can be any amino acid
  VARIANT 44: note = X can be any amino acid except P or G
  VARIANT 45: note = X can be any amino acid except P or G
  VARIANT 46: note = X can be any amino acid except P or G
  VARIANT 48: note = X can be any amino acid
  VARIANT 49: note = X can be any amino acid
  VARIANT 50: note = X can be any amino acid
  VARIANT 52: note = X can be any amino acid except P or G
  VARIANT 53: note = X can be any amino acid except P or G
  VARIANT 54: note = X can be any amino acid except P or G
  VARIANT 56: note = X can be any amino acid
  VARIANT 57: note = X can be any amino acid
  VARIANT 58: note = X can be any amino acid
  VARIANT 60: note = X can be any amino acid except P or G
  VARIANT 61: note = X can be any amino acid except P or G
  VARIANT 62: note = X can be any amino acid except P or G
  VARIANT 64: note = X can be any amino acid
  VARIANT 65: note = X can be any amino acid
  VARIANT 66: note = X can be any amino acid
  VARIANT 68: note = X can be any amino acid except P or G
  VARIANT 69: note = X can be any amino acid except P or G
  VARIANT 70: note = X can be any amino acid except P or G
  VARIANT 72: note = X can be any amino acid
  VARIANT 73: note = X can be any amino acid
  VARIANT 74: note = X can be any amino acid
  VARIANT 76: note = X can be any amino acid except P or G
  VARIANT 77: note = X can be any amino acid except P or G
  VARIANT 78: note = X can be any amino acid except P or G
  VARIANT 80: note = X can be any amino acid
  VARIANT 81: note = X can be any amino acid
  VARIANT 82: note = X can be any amino acid
  VARIANT 84: note = X can be any amino acid except P or G
  VARIANT 85: note = X can be any amino acid except P or G
  VARIANT 86: note = X can be any amino acid except P or G
  VARIANT 88: note = X can be any amino acid
  VARIANT 89: note = X can be any amino acid
  VARIANT 90: note = X can be any amino acid
  VARIANT 92: note = X can be any amino acid except P or G
  VARIANT 93: note = X can be any amino acid except P or G
  VARIANT 94: note = X can be any amino acid except P or G
  VARIANT 96: note = X can be any amino acid
  VARIANT 97: note = X can be any amino acid
  VARIANT 98: note = X can be any amino acid
  VARIANT 100: note = X can be any amino acid except P or G
  VARIANT 101: note = X can be any amino acid except P or G
  VARIANT 102: note = X can be any amino acid except P or G
  VARIANT 104: note = X can be any amino acid
  VARIANT 105: note = X can be any amino acid
  VARIANT 106: note = X can be any amino acid
  VARIANT 108: note = X can be any amino acid except P or G
  VARIANT 109: note = X can be any amino acid except P or G
  VARIANT 110: note = X can be any amino acid except P or G
  VARIANT 112: note = X can be any amino acid
  VARIANT 113: note = X can be any amino acid
  VARIANT 114: note = X can be any amino acid
  VARIANT 116: note = X can be any amino acid except P or G
  VARIANT 117: note = X can be any amino acid except P or G
  VARIANT 118: note = X can be any amino acid except P or G
  VARIANT 120: note = X can be any amino acid
  VARIANT 121: note = X can be any amino acid
  VARIANT 122: note = X can be any amino acid
  VARIANT 124: note = X can be any amino acid except P or G
  VARIANT 125: note = X can be any amino acid except P or G
  VARIANT 126: note = X can be any amino acid except P or G
  VARIANT 128: note = X can be any amino acid
  VARIANT 129: note = X can be any amino acid
  VARIANT 130: note = X can be any amino acid
  VARIANT 132: note = X can be any amino acid except P or G
  VARIANT 133: note = X can be any amino acid except P or G
  VARIANT 134: note = X can be any amino acid except P or G
  VARIANT 136: note = X can be any amino acid
  VARIANT 137: note = X can be any amino acid
  VARIANT 138: note = X can be any amino acid
  VARIANT 140: note = X can be any amino acid except P or G
  VARIANT 141: note = X can be any amino acid except P or G
  VARIANT 142: note = X can be any amino acid except P or G
  VARIANT 144: note = X can be any amino acid
  VARIANT 145: note = X can be any amino acid
  VARIANT 146: note = X can be any amino acid
  VARIANT 148: note = X can be any amino acid except P or G
  VARIANT 149: note = X can be any amino acid except P or G
  VARIANT 150: note = X can be any amino acid except P or G
  VARIANT 152: note = X can be any amino acid
  VARIANT 153: note = X can be any amino acid
  VARIANT 154: note = X can be any amino acid
  VARIANT 156: note = X can be any amino acid except P or G
  VARIANT 157: note = X can be any amino acid except P or G
  VARIANT 158: note = X can be any amino acid except P or G
  VARIANT 160: note = X can be any amino acid
  VARIANT 161: note = X can be any amino acid
  VARIANT 162: note = X can be any amino acid
  VARIANT 164: note = X can be any amino acid except P or G
  VARIANT 165: note = X can be any amino acid except P or G
  VARIANT 166: note = X can be any amino acid except P or G
  VARIANT 168: note = X can be any amino acid
  VARIANT 169: note = X can be any amino acid
  VARIANT 170: note = X can be any amino acid
  VARIANT 172: note = X can be any amino acid except P or G
  VARIANT 173: note = X can be any amino acid except P or G
  VARIANT 174: note = X can be any amino acid except P or G
  VARIANT 176: note = X can be any amino acid
  VARIANT 177: note = X can be any amino acid
  VARIANT 178: note = X can be any amino acid
  VARIANT 180: note = X can be any amino acid except P or G
  VARIANT 181: note = X can be any amino acid except P or G
  VARIANT 182: note = X can be any amino acid except P or G
  VARIANT 184: note = X can be any amino acid
  VARIANT 185: note = X can be any amino acid
  VARIANT 186: note = X can be any amino acid
  VARIANT 188: note = X can be any amino acid except P or G
  VARIANT 189: note = X can be any amino acid except P or G
  VARIANT 190: note = X can be any amino acid except P or G
  VARIANT 192: note = X can be any amino acid
  VARIANT 193: note = X can be any amino acid
  VARIANT 194: note = X can be any amino acid
  VARIANT 196: note = X can be any amino acid except P or G
  VARIANT 197: note = X can be any amino acid except P or G
  VARIANT 198: note = X can be any amino acid except P or G
  VARIANT 200: note = X can be any amino acid
  VARIANT 201: note = X can be any amino acid
  VARIANT 202: note = X can be any amino acid
  VARIANT 204: note = X can be any amino acid except P or G
  VARIANT 205: note = X can be any amino acid except P or G
  VARIANT 206: note = X can be any amino acid except P or G
  VARIANT 208: note = X can be any amino acid
  VARIANT 209: note = X can be any amino acid
  VARIANT 210: note = X can be any amino acid
  VARIANT 212: note = X can be any amino acid except P or G
  VARIANT 213: note = X can be any amino acid except P or G
  VARIANT 214: note = X can be any amino acid except P or G
  VARIANT 216: note = X can be any amino acid
  VARIANT 217: note = X can be any amino acid
  VARIANT 218: note = X can be any amino acid
  VARIANT 220: note = X can be any amino acid except P or G
  VARIANT 221: note = X can be any amino acid except P or G
  VARIANT 222: note = X can be any amino acid except P or G
  VARIANT 224: note = X can be any amino acid
  VARIANT 225: note = X can be any amino acid
  VARIANT 226: note = X can be any amino acid
  VARIANT 228: note = X can be any amino acid except P or G
  VARIANT 229: note = X can be any amino acid except P or G
  VARIANT 230: note = X can be any amino acid except P or G
  VARIANT 232: note = X can be any amino acid
  VARIANT 233: note = X can be any amino acid
  VARIANT 234: note = X can be any amino acid
  VARIANT 236: note = X can be any amino acid except P or G
  VARIANT 237: note = X can be any amino acid except P or G
  VARIANT 238: note = X can be any amino acid except P or G
  VARIANT 240: note = X can be any amino acid
  VARIANT 241: note = X can be any amino acid
  VARIANT 242: note = X can be any amino acid
  VARIANT 244: note = X can be any amino acid except P or G
  VARIANT 245: note = X can be any amino acid except P or G
  VARIANT 246: note = X can be any amino acid except P or G
  VARIANT 248: note = X can be any amino acid
  VARIANT 249: note = X can be any amino acid
  VARIANT 250: note = X can be any amino acid
  VARIANT 252: note = X can be any amino acid except P or G
  VARIANT 253: note = X can be any amino acid except P or G
  VARIANT 254: note = X can be any amino acid except P or G
  VARIANT 256: note = X can be any amino acid
  VARIANT 257: note = X can be any amino acid
  VARIANT 258: note = X can be any amino acid
  VARIANT 260: note = X can be any amino acid except P or G
  VARIANT 261: note = X can be any amino acid except P or G
  VARIANT 262: note = X can be any amino acid except P or G
  VARIANT 264: note = X can be any amino acid
  VARIANT 265: note = X can be any amino acid
  VARIANT 266: note = X can be any amino acid
  VARIANT 268: note = X can be any amino acid except P or G
  VARIANT 269: note = X can be any amino acid except P or G
  VARIANT 270: note = X can be any amino acid except P or G
  VARIANT 272: note = X can be any amino acid
  VARIANT 273: note = X can be any amino acid
  VARIANT 274: note = X can be any amino acid
  VARIANT 276: note = X can be any amino acid except P or G
  VARIANT 277: note = X can be any amino acid except P or G
  VARIANT 278: note = X can be any amino acid except P or G
  VARIANT 280: note = X can be any amino acid
  VARIANT 281: note = X can be any amino acid
  VARIANT 282: note = X can be any amino acid
  VARIANT 284: note = X can be any amino acid except P or G
  VARIANT 285: note = X can be any amino acid except P or G
  VARIANT 286: note = X can be any amino acid except P or G
  VARIANT 288: note = X can be any amino acid
  VARIANT 289: note = X can be any amino acid
  VARIANT 290: note = X can be any amino acid
  VARIANT 292: note = X can be any amino acid except P or G
  VARIANT 293: note = X can be any amino acid except P or G
  VARIANT 294: note = X can be any amino acid except P or G
  VARIANT 296: note = X can be any amino acid
  VARIANT 297: note = X can be any amino acid
  VARIANT 298: note = X can be any amino acid
  VARIANT 300: note = X can be any amino acid except P or G
  VARIANT 301: note = X can be any amino acid except P or G
  VARIANT 302: note = X can be any amino acid except P or G
  VARIANT 304: note = X can be any amino acid
  VARIANT 305: note = X can be any amino acid
  VARIANT 306: note = X can be any amino acid
  VARIANT 308: note = X can be any amino acid except P or G
  VARIANT 309: note = X can be any amino acid except P or G
  VARIANT 310: note = X can be any amino acid except P or G
  VARIANT 312: note = X can be any amino acid
  VARIANT 313: note = X can be any amino acid
  VARIANT 314: note = X can be any amino acid
  VARIANT 316: note = X can be any amino acid except P or G
  VARIANT 317: note = X can be any amino acid except P or G
  VARIANT 318: note = X can be any amino acid except P or G
  VARIANT 320: note = X can be any amino acid
  VARIANT 321: note = X can be any amino acid
  VARIANT 322: note = X can be any amino acid
  VARIANT 324: note = X can be any amino acid except P or G
  VARIANT 325: note = X can be any amino acid except P or G
  VARIANT 326: note = X can be any amino acid except P or G
  VARIANT 328: note = X can be any amino acid
  VARIANT 329: note = X can be any amino acid
  VARIANT 330: note = X can be any amino acid
  VARIANT 332: note = X can be any amino acid except P or G
  VARIANT 333: note = X can be any amino acid except P or G
  VARIANT 334: note = X can be any amino acid except P or G
  VARIANT 336: note = X can be any amino acid
  VARIANT 337: note = X can be any amino acid
  VARIANT 338: note = X can be any amino acid
  VARIANT 340: note = X can be any amino acid except P or G
  VARIANT 341: note = X can be any amino acid except P or G
  VARIANT 342: note = X can be any amino acid except P or G
  VARIANT 344: note = X can be any amino acid
  VARIANT 345: note = X can be any amino acid
  VARIANT 346: note = X can be any amino acid
  VARIANT 348: note = X can be any amino acid except P or G
  VARIANT 349: note = X can be any amino acid except P or G
  VARIANT 350: note = X can be any amino acid except P or G
  VARIANT 352: note = X can be any amino acid
  VARIANT 353: note = X can be any amino acid
  VARIANT 354: note = X can be any amino acid
  VARIANT 356: note = X can be any amino acid except P or G
  VARIANT 357: note = X can be any amino acid except P or G
  VARIANT 358: note = X can be any amino acid except P or G
  VARIANT 360: note = X can be any amino acid
  VARIANT 361: note = X can be any amino acid
  VARIANT 362: note = X can be any amino acid
  VARIANT 364: note = X can be any amino acid except P or G
  VARIANT 365: note = X can be any amino acid except P or G
  VARIANT 366: note = X can be any amino acid except P or G
  VARIANT 368: note = X can be any amino acid
  VARIANT 369: note = X can be any amino acid
  VARIANT 370: note = X can be any amino acid
  VARIANT 372: note = X can be any amino acid except P or G
  VARIANT 373: note = X can be any amino acid except P or G
  VARIANT 374: note = X can be any amino acid except P or G
  VARIANT 376: note = X can be any amino acid
  VARIANT 377: note = X can be any amino acid
  VARIANT 378: note = X can be any amino acid
  VARIANT 380: note = X can be any amino acid except P or G
  VARIANT 381: note = X can be any amino acid except P or G
  VARIANT 382: note = X can be any amino acid except P or G
  VARIANT 384: note = X can be any amino acid
  VARIANT 385: note = X can be any amino acid
  VARIANT 386: note = X can be any amino acid
  VARIANT 388: note = X can be any amino acid except P or G
  VARIANT 389: note = X can be any amino acid except P or G
  VARIANT 390: note = X can be any amino acid except P or G
  VARIANT 392: note = X can be any amino acid
  VARIANT 393: note = X can be any amino acid
  VARIANT 394: note = X can be any amino acid
  VARIANT 396: note = X can be any amino acid except P or G
  VARIANT 397: note = X can be any amino acid except P or G
  VARIANT 398: note = X can be any amino acid except P or G
  VARIANT 400: note = X can be any amino acid
  VARIANT 401: note = X can be any amino acid
  VARIANT 402: note = X can be any amino acid
  VARIANT 404: note = X can be any amino acid except P or G
  VARIANT 405: note = X can be any amino acid except P or G
  VARIANT 406: note = X can be any amino acid except P or G
  VARIANT 408: note = X can be any amino acid
  VARIANT 409: note = X can be any amino acid
  VARIANT 410: note = X can be any amino acid
  VARIANT 412: note = X can be any amino acid except P or G
  VARIANT 413: note = X can be any amino acid except P or G
  VARIANT 414: note = X can be any amino acid except P or G
  VARIANT 416: note = X can be any amino acid
  VARIANT 417: note = X can be any amino acid
  VARIANT 418: note = X can be any amino acid
  VARIANT 420: note = X can be any amino acid except P or G
  VARIANT 421: note = X can be any amino acid except P or G
  VARIANT 422: note = X can be any amino acid except P or G
  VARIANT 424: note = X can be any amino acid
  VARIANT 425: note = X can be any amino acid
  VARIANT 426: note = X can be any amino acid
  VARIANT 428: note = X can be any amino acid except P or G
  VARIANT 429: note = X can be any amino acid except P or G
  VARIANT 430: note = X can be any amino acid except P or G
  VARIANT 432: note = X can be any amino acid
  VARIANT 433: note = X can be any amino acid
  VARIANT 434: note = X can be any amino acid
  VARIANT 436: note = X can be any amino acid except P or G
  VARIANT 437: note = X can be any amino acid except P or G
  VARIANT 438: note = X can be any amino acid except P or G
  VARIANT 440: note = X can be any amino acid
  VARIANT 441: note = X can be any amino acid
  VARIANT 442: note = X can be any amino acid
  VARIANT 444: note = X can be any amino acid except P or G
  VARIANT 445: note = X can be any amino acid except P or G
  VARIANT 446: note = X can be any amino acid except P or G
  VARIANT 448: note = X can be any amino acid
  VARIANT 449: note = X can be any amino acid
  VARIANT 450: note = X can be any amino acid
  VARIANT 452: note = X can be any amino acid except P or G
  VARIANT 453: note = X can be any amino acid except P or G
  VARIANT 454: note = X can be any amino acid except P or G
  VARIANT 456: note = X can be any amino acid
  VARIANT 457: note = X can be any amino acid
  VARIANT 458: note = X can be any amino acid
  VARIANT 460: note = X can be any amino acid except P or G
  VARIANT 461: note = X can be any amino acid except P or G
  VARIANT 462: note = X can be any amino acid except P or G
  VARIANT 464: note = X can be any amino acid
  VARIANT 465: note = X can be any amino acid
  VARIANT 466: note = X can be any amino acid
  VARIANT 468: note = X can be any amino acid except P or G
  VARIANT 469: note = X can be any amino acid except P or G
  VARIANT 470: note = X can be any amino acid except P or G
  VARIANT 472: note = X can be any amino acid
  VARIANT 473: note = X can be any amino acid
  VARIANT 474: note = X can be any amino acid
  VARIANT 476: note = X can be any amino acid except P or G
  VARIANT 477: note = X can be any amino acid except P or G
  VARIANT 478: note = X can be any amino acid except P or G
  VARIANT 480: note = X can be any amino acid
  VARIANT 481: note = X can be any amino acid
  VARIANT 482: note = X can be any amino acid
  VARIANT 484: note = X can be any amino acid except P or G
  VARIANT 485: note = X can be any amino acid except P or G
  VARIANT 486: note = X can be any amino acid except P or G
  VARIANT 488: note = X can be any amino acid
  VARIANT 489: note = X can be any amino acid
  VARIANT 490: note = X can be any amino acid
  VARIANT 492: note = X can be any amino acid except P or G
  VARIANT 493: note = X can be any amino acid except P or G
  VARIANT 494: note = X can be any amino acid except P or G
  VARIANT 496: note = X can be any amino acid
  VARIANT 497: note = X can be any amino acid
  VARIANT 498: note = X can be any amino acid
  VARIANT 500: note = X can be any amino acid except P or G
  VARIANT 501: note = X can be any amino acid except P or G
  VARIANT 502: note = X can be any amino acid except P or G
  VARIANT 504: note = X can be any amino acid
  VARIANT 505: note = X can be any amino acid
  VARIANT 506: note = X can be any amino acid
  VARIANT 508: note = X can be any amino acid except P or G
  VARIANT 509: note = X can be any amino acid except P or G
  VARIANT 510: note = X can be any amino acid except P or G
  VARIANT 512: note = X can be any amino acid
  VARIANT 513: note = X can be any amino acid
  VARIANT 514: note = X can be any amino acid
  VARIANT 516: note = X can be any amino acid except P or G
  VARIANT 517: note = X can be any amino acid except P or G
  VARIANT 518: note = X can be any amino acid except P or G
  VARIANT 520: note = X can be any amino acid
  VARIANT 521: note = X can be any amino acid
  VARIANT 522: note = X can be any amino acid
  VARIANT 524: note = X can be any amino acid except P or G
  VARIANT 525: note = X can be any amino acid except P or G
  VARIANT 526: note = X can be any amino acid except P or G
  VARIANT 528: note = X can be any amino acid
  VARIANT 529: note = X can be any amino acid
  VARIANT 530: note = X can be any amino acid
  VARIANT 532: note = X can be any amino acid except P or G
  VARIANT 533: note = X can be any amino acid except P or G
  VARIANT 534: note = X can be any amino acid except P or G
  VARIANT 536: note = X can be any amino acid
  VARIANT 537: note = X can be any amino acid
  VARIANT 538: note = X can be any amino acid
  VARIANT 540: note = X can be any amino acid except P or G
  VARIANT 541: note = X can be any amino acid except P or G
  VARIANT 542: note = X can be any amino acid except P or G
  VARIANT 544: note = X can be any amino acid
  VARIANT 545: note = X can be any amino acid
  VARIANT 546: note = X can be any amino acid
  VARIANT 548: note = X can be any amino acid except P or G
  VARIANT 549: note = X can be any amino acid except P or G
  VARIANT 550: note = X can be any amino acid except P or G
  VARIANT 552: note = X can be any amino acid
  VARIANT 553: note = X can be any amino acid
  VARIANT 554: note = X can be any amino acid
  VARIANT 556: note = X can be any amino acid except P or G
  VARIANT 557: note = X can be any amino acid except P or G
  VARIANT 558: note = X can be any amino acid except P or G
  VARIANT 560: note = X can be any amino acid
  VARIANT 561: note = X can be any amino acid
  VARIANT 562: note = X can be any amino acid
  VARIANT 564: note = X can be any amino acid except P or G
  VARIANT 565: note = X can be any amino acid except P or G
  VARIANT 566: note = X can be any amino acid except P or G
  VARIANT 568: note = X can be any amino acid
  VARIANT 569: note = X can be any amino acid
  VARIANT 570: note = X can be any amino acid
  VARIANT 572: note = X can be any amino acid except P or G
  VARIANT 573: note = X can be any amino acid except P or G
  VARIANT 574: note = X can be any amino acid except P or G
  VARIANT 576: note = X can be any amino acid
  VARIANT 577: note = X can be any amino acid
  VARIANT 578: note = X can be any amino acid
  VARIANT 580: note = X can be any amino acid except P or G
  VARIANT 581: note = X can be any amino acid except P or G
  VARIANT 582: note = X can be any amino acid except P or G
  VARIANT 584: note = X can be any amino acid
  VARIANT 585: note = X can be any amino acid
  VARIANT 586: note = X can be any amino acid
  VARIANT 588: note = X can be any amino acid except P or G
  VARIANT 589: note = X can be any amino acid except P or G
  VARIANT 590: note = X can be any amino acid except P or G
  VARIANT 592: note = X can be any amino acid
  VARIANT 593: note = X can be any amino acid
  VARIANT 594: note = X can be any amino acid
  VARIANT 596: note = X can be any amino acid except P or G
  VARIANT 597: note = X can be any amino acid except P or G
  VARIANT 598: note = X can be any amino acid except P or G
  VARIANT 600: note = X can be any amino acid
  VARIANT 601: note = X can be any amino acid
  VARIANT 602: note = X can be any amino acid
  VARIANT 604: note = X can be any amino acid except P or G
  VARIANT 605: note = X can be any amino acid except P or G
  VARIANT 606: note = X can be any amino acid except P or G
  VARIANT 608: note = X can be any amino acid
  VARIANT 609: note = X can be any amino acid
  VARIANT 610: note = X can be any amino acid
  VARIANT 612: note = X can be any amino acid except P or G
  VARIANT 613: note = X can be any amino acid except P or G
  VARIANT 614: note = X can be any amino acid except P or G
  VARIANT 616: note = X can be any amino acid
  VARIANT 617: note = X can be any amino acid
  VARIANT 618: note = X can be any amino acid
  VARIANT 620: note = X can be any amino acid except P or G
  VARIANT 621: note = X can be any amino acid except P or G
  VARIANT 622: note = X can be any amino acid except P or G
  VARIANT 624: note = X can be any amino acid
  VARIANT 625: note = X can be any amino acid
  VARIANT 626: note = X can be any amino acid
  VARIANT 628: note = X can be any amino acid except P or G
  VARIANT 629: note = X can be any amino acid except P or G
  VARIANT 630: note = X can be any amino acid except P or G
  VARIANT 632: note = X can be any amino acid
  VARIANT 633: note = X can be any amino acid
  VARIANT 634: note = X can be any amino acid
  VARIANT 636: note = X can be any amino acid except P or G
  VARIANT 637: note = X can be any amino acid except P or G
  VARIANT 638: note = X can be any amino acid except P or G
  VARIANT 640: note = X can be any amino acid
  VARIANT 641: note = X can be any amino acid
  VARIANT 642: note = X can be any amino acid
  VARIANT 644: note = X can be any amino acid except P or G
  VARIANT 645: note = X can be any amino acid except P or G
  VARIANT 646: note = X can be any amino acid except P or G
  VARIANT 648: note = X can be any amino acid
  VARIANT 649: note = X can be any amino acid
  VARIANT 650: note = X can be any amino acid
  VARIANT 652: note = X can be any amino acid except P or G
  VARIANT 653: note = X can be any amino acid except P or G
  VARIANT 654: note = X can be any amino acid except P or G
  VARIANT 656: note = X can be any amino acid
  VARIANT 657: note = X can be any amino acid
  VARIANT 658: note = X can be any amino acid
  VARIANT 660: note = X can be any amino acid except P or G
  VARIANT 661: note = X can be any amino acid except P or G
  VARIANT 662: note = X can be any amino acid except P or G
  VARIANT 664: note = X can be any amino acid
  VARIANT 665: note = X can be any amino acid
  VARIANT 666: note = X can be any amino acid
  VARIANT 668: note = X can be any amino acid except P or G
  VARIANT 669: note = X can be any amino acid except P or G
  VARIANT 670: note = X can be any amino acid except P or G
  VARIANT 672: note = X can be any amino acid
  VARIANT 673: note = X can be any amino acid
  VARIANT 674: note = X can be any amino acid
  VARIANT 676: note = X can be any amino acid except P or G
  VARIANT 677: note = X can be any amino acid except P or G
  VARIANT 678: note = X can be any amino acid except P or G
  VARIANT 680: note = X can be any amino acid
  VARIANT 681: note = X can be any amino acid
  VARIANT 682: note = X can be any amino acid
  VARIANT 684: note = X can be any amino acid except P or G
  VARIANT 685: note = X can be any amino acid except P or G
  VARIANT 686: note = X can be any amino acid except P or G
  VARIANT 688: note = X can be any amino acid
  VARIANT 689: note = X can be any amino acid
  VARIANT 690: note = X can be any amino acid
  VARIANT 692: note = X can be any amino acid except P or G
  VARIANT 693: note = X can be any amino acid except P or G
  VARIANT 694: note = X can be any amino acid except P or G
  VARIANT 696: note = X can be any amino acid
  VARIANT 697: note = X can be any amino acid
  VARIANT 698: note = X can be any amino acid
  VARIANT 700: note = X can be any amino acid except P or G
  VARIANT 701: note = X can be any amino acid except P or G
  VARIANT 702: note = X can be any amino acid except P or G
  VARIANT 704: note = X can be any amino acid
  VARIANT 705: note = X can be any amino acid
  VARIANT 706: note = X can be any amino acid
  VARIANT 708: note = X can be any amino acid except P or G
  VARIANT 709: note = X can be any amino acid except P or G
  VARIANT 710: note = X can be any amino acid except P or G
  VARIANT 712: note = X can be any amino acid
  VARIANT 713: note = X can be any amino acid
  VARIANT 714: note = X can be any amino acid
  VARIANT 716: note = X can be any amino acid except P or G
  VARIANT 717: note = X can be any amino acid except P or G
  VARIANT 718: note = X can be any amino acid except P or G
  VARIANT 720: note = X can be any amino acid
  VARIANT 721: note = X can be any amino acid
  VARIANT 722: note = X can be any amino acid
  VARIANT 724: note = X can be any amino acid except P or G
  VARIANT 725: note = X can be any amino acid except P or G
  VARIANT 726: note = X can be any amino acid except P or G
  VARIANT 728: note = X can be any amino acid
  VARIANT 729: note = X can be any amino acid
  VARIANT 730: note = X can be any amino acid
  VARIANT 732: note = X can be any amino acid except P or G
  VARIANT 733: note = X can be any amino acid except P or G
  VARIANT 734: note = X can be any amino acid except P or G
  VARIANT 736: note = X can be any amino acid
  VARIANT 737: note = X can be any amino acid
  VARIANT 738: note = X can be any amino acid
  VARIANT 740: note = X can be any amino acid except P or G
  VARIANT 741: note = X can be any amino acid except P or G
  VARIANT 742: note = X can be any amino acid except P or G
  VARIANT 744: note = X can be any amino acid
  VARIANT 745: note = X can be any amino acid
  VARIANT 746: note = X can be any amino acid
  VARIANT 748: note = X can be any amino acid except P or G
  VARIANT 749: note = X can be any amino acid except P or G
  VARIANT 750: note = X can be any amino acid except P or G
  VARIANT 752: note = X can be any amino acid
  VARIANT 753: note = X can be any amino acid
  VARIANT 754: note = X can be any amino acid
  VARIANT 756: note = X can be any amino acid except P or G
  VARIANT 757: note = X can be any amino acid except P or G
  VARIANT 758: note = X can be any amino acid except P or G
  VARIANT 760: note = X can be any amino acid
  VARIANT 761: note = X can be any amino acid
  VARIANT 762: note = X can be any amino acid
  VARIANT 764: note = X can be any amino acid except P or G
  VARIANT 765: note = X can be any amino acid except P or G
  VARIANT 766: note = X can be any amino acid except P or G
  VARIANT 768: note = X can be any amino acid
  VARIANT 769: note = X can be any amino acid
  VARIANT 770: note = X can be any amino acid
  VARIANT 772: note = X can be any amino acid except P or G
  VARIANT 773: note = X can be any amino acid except P or G
  VARIANT 774: note = X can be any amino acid except P or G
  VARIANT 776: note = X can be any amino acid
  VARIANT 777: note = X can be any amino acid
  VARIANT 778: note = X can be any amino acid
  VARIANT 780: note = X can be any amino acid except P or G
  VARIANT 781: note = X can be any amino acid except P or G
  VARIANT 782: note = X can be any amino acid except P or G
  VARIANT 784: note = X can be any amino acid
  VARIANT 785: note = X can be any amino acid
  VARIANT 786: note = X can be any amino acid
  VARIANT 788: note = X can be any amino acid except P or G
  VARIANT 789: note = X can be any amino acid except P or G
  VARIANT 790: note = X can be any amino acid except P or G
  VARIANT 792: note = X can be any amino acid
  VARIANT 793: note = X can be any amino acid
  VARIANT 794: note = X can be any amino acid
  VARIANT 796: note = X can be any amino acid except P or G
  VARIANT 797: note = X can be any amino acid except P or G
  VARIANT 798: note = X can be any amino acid except P or G
  VARIANT 800: note = X can be any amino acid
  VARIANT 801: note = X can be any amino acid
  VARIANT 802: note = X can be any amino acid
  VARIANT 804: note = X can be any amino acid except P or G
  VARIANT 805: note = X can be any amino acid except P or G
  VARIANT 806: note = X can be any amino acid except P or G
  VARIANT 808: note = X can be any amino acid
  VARIANT 809: note = X can be any amino acid
  VARIANT 810: note = X can be any amino acid
  VARIANT 812: note = X can be any amino acid except P or G
  VARIANT 813: note = X can be any amino acid except P or G
  VARIANT 814: note = X can be any amino acid except P or G
  VARIANT 816: note = X can be any amino acid
  VARIANT 817: note = X can be any amino acid
  VARIANT 818: note = X can be any amino acid
  VARIANT 820: note = X can be any amino acid except P or G
  VARIANT 821: note = X can be any amino acid except P or G
  VARIANT 822: note = X can be any amino acid except P or G
  VARIANT 824: note = X can be any amino acid
  VARIANT 825: note = X can be any amino acid
  VARIANT 826: note = X can be any amino acid
  VARIANT 828: note = X can be any amino acid except P or G
  VARIANT 829: note = X can be any amino acid except P or G
  VARIANT 830: note = X can be any amino acid except P or G
  VARIANT 832: note = X can be any amino acid
  VARIANT 833: note = X can be any amino acid
  VARIANT 834: note = X can be any amino acid
  VARIANT 836: note = X can be any amino acid except P or G
  VARIANT 837: note = X can be any amino acid except P or G
  VARIANT 838: note = X can be any amino acid except P or G
  VARIANT 840: note = X can be any amino acid
  VARIANT 841: note = X can be any amino acid
  VARIANT 842: note = X can be any amino acid
  VARIANT 844: note = X can be any amino acid except P or G
  VARIANT 845: note = X can be any amino acid except P or G
  VARIANT 846: note = X can be any amino acid except P or G
  VARIANT 848: note = X can be any amino acid
  VARIANT 849: note = X can be any amino acid
  VARIANT 850: note = X can be any amino acid
  VARIANT 852: note = X can be any amino acid except P or G
  VARIANT 853: note = X can be any amino acid except P or G
  VARIANT 854: note = X can be any amino acid except P or G
  VARIANT 856: note = X can be any amino acid
  VARIANT 857: note = X can be any amino acid
  VARIANT 858: note = X can be any amino acid
  VARIANT 860: note = X can be any amino acid except P or G
  VARIANT 861: note = X can be any amino acid except P or G
  VARIANT 862: note = X can be any amino acid except P or G
  VARIANT 864: note = X can be any amino acid
  VARIANT 865: note = X can be any amino acid
  VARIANT 866: note = X can be any amino acid
  VARIANT 868: note = X can be any amino acid except P or G
  VARIANT 869: note = X can be any amino acid except P or G
  VARIANT 870: note = X can be any amino acid except P or G
  VARIANT 872: note = X can be any amino acid
  VARIANT 873: note = X can be any amino acid
  VARIANT 874: note = X can be any amino acid
  VARIANT 876: note = X can be any amino acid except P or G
  VARIANT 877: note = X can be any amino acid except P or G
  VARIANT 878: note = X can be any amino acid except P or G
  VARIANT 880: note = X can be any amino acid
  VARIANT 881: note = X can be any amino acid
  VARIANT 882: note = X can be any amino acid
  VARIANT 884: note = X can be any amino acid except P or G
  VARIANT 885: note = X can be any amino acid except P or G
  VARIANT 886: note = X can be any amino acid except P or G
  VARIANT 888: note = X can be any amino acid
  VARIANT 889: note = X can be any amino acid
  VARIANT 890: note = X can be any amino acid
  VARIANT 892: note = X can be any amino acid except P or G
  VARIANT 893: note = X can be any amino acid except P or G
  VARIANT 894: note = X can be any amino acid except P or G
  VARIANT 896: note = X can be any amino acid
  VARIANT 897: note = X can be any amino acid
  VARIANT 898: note = X can be any amino acid
  VARIANT 900: note = X can be any amino acid except P or G
  VARIANT 901: note = X can be any amino acid except P or G
  VARIANT 902: note = X can be any amino acid except P or G
  VARIANT 904: note = X can be any amino acid
  VARIANT 905: note = X can be any amino acid
  VARIANT 906: note = X can be any amino acid
  VARIANT 908: note = X can be any amino acid except P or G
  VARIANT 909: note = X can be any amino acid except P or G
  VARIANT 910: note = X can be any amino acid except P or G
  VARIANT 912: note = X can be any amino acid
  VARIANT 913: note = X can be any amino acid
  VARIANT 914: note = X can be any amino acid
  VARIANT 916: note = X can be any amino acid except P or G
  VARIANT 917: note = X can be any amino acid except P or G
  VARIANT 918: note = X can be any amino acid except P or G
  VARIANT 920: note = X can be any amino acid
  VARIANT 921: note = X can be any amino acid
  VARIANT 922: note = X can be any amino acid
  VARIANT 924: note = X can be any amino acid except P or G
  VARIANT 925: note = X can be any amino acid except P or G
  VARIANT 926: note = X can be any amino acid except P or G
  VARIANT 928: note = X can be any amino acid
  VARIANT 929: note = X can be any amino acid
  VARIANT 930: note = X can be any amino acid
  VARIANT 932: note = X can be any amino acid except P or G
  VARIANT 933: note = X can be any amino acid except P or G
  VARIANT 934: note = X can be any amino acid except P or G
  VARIANT 936: note = X can be any amino acid
  VARIANT 937: note = X can be any amino acid
  VARIANT 938: note = X can be any amino acid
  VARIANT 940: note = X can be any amino acid except P or G
  VARIANT 941: note = X can be any amino acid except P or G
  VARIANT 942: note = X can be any amino acid except P or G
  VARIANT 944: note = X can be any amino acid
  VARIANT 945: note = X can be any amino acid
  VARIANT 946: note = X can be any amino acid
  VARIANT 948: note = X can be any amino acid except P or G
  VARIANT 949: note = X can be any amino acid except P or G
  VARIANT 950: note = X can be any amino acid except P or G
  VARIANT 952: note = X can be any amino acid
  VARIANT 953: note = X can be any amino acid
  VARIANT 954: note = X can be any amino acid
  VARIANT 956: note = X can be any amino acid except P or G
  VARIANT 957: note = X can be any amino acid except P or G
  VARIANT 958: note = X can be any amino acid except P or G
  VARIANT 960: note = X can be any amino acid
  VARIANT 961: note = X can be any amino acid
  VARIANT 962: note = X can be any amino acid
  VARIANT 964: note = X can be any amino acid except P or G
  VARIANT 965: note = X can be any amino acid except P or G
  VARIANT 966: note = X can be any amino acid except P or G
  VARIANT 968: note = X can be any amino acid
  VARIANT 969: note = X can be any amino acid
  VARIANT 970: note = X can be any amino acid
  VARIANT 972: note = X can be any amino acid except P or G
  VARIANT 973: note = X can be any amino acid except P or G
  VARIANT 974: note = X can be any amino acid except P or G
  VARIANT 976: note = X can be any amino acid
  VARIANT 977: note = X can be any amino acid
  VARIANT 978: note = X can be any amino acid
  VARIANT 980: note = X can be any amino acid except P or G
  VARIANT 981: note = X can be any amino acid except P or G
  VARIANT 982: note = X can be any amino acid except P or G
  VARIANT 984: note = X can be any amino acid
  VARIANT 985: note = X can be any amino acid
  VARIANT 986: note = X can be any amino acid
  VARIANT 988: note = X can be any amino acid except P or G
  VARIANT 989: note = X can be any amino acid except P or G
  VARIANT 990: note = X can be any amino acid except P or G
  VARIANT 992: note = X can be any amino acid
  VARIANT 993: note = X can be any amino acid
  VARIANT 994: note = X can be any amino acid
  VARIANT 996: note = X can be any amino acid except P or G
  VARIANT 997: note = X can be any amino acid except P or G
  VARIANT 998: note = X can be any amino acid except P or G
  VARIANT 1000: note = X can be any amino acid
  VARIANT 1001: note = X can be any amino acid
  VARIANT 1002: note = X can be any amino acid
  VARIANT 1004: note = X can be any amino acid except P or G
  VARIANT 1005: note = X can be any amino acid except P or G
  VARIANT 1006: note = X can be any amino acid except P or G
  VARIANT 1008: note = X can be any amino acid
  VARIANT 1009: note = X can be any amino acid
  VARIANT 1010: note = X can be any amino acid
  VARIANT 1012: note = X can be any amino acid except P or G
  VARIANT 1013: note = X can be any amino acid except P or G
  VARIANT 1014: note = X can be any amino acid except P or G
  VARIANT 1016: note = X can be any amino acid
  VARIANT 1017: note = X can be any amino acid
  VARIANT 1018: note = X can be any amino acid
  VARIANT 1020: note = X can be any amino acid except P or G
  VARIANT 1021: note = X can be any amino acid except P or G
  VARIANT 1022: note = X can be any amino acid except P or G
  VARIANT 1024: note = X can be any amino acid
  VARIANT 1025: note = X can be any amino acid
  VARIANT 1026: note = X can be any amino acid
  VARIANT 1028: note = X can be any amino acid except P or G
  VARIANT 1029: note = X can be any amino acid except P or G
  VARIANT 1030: note = X can be any amino acid except P or G
  VARIANT 1032: note = X can be any amino acid
  VARIANT 1033: note = X can be any amino acid
  VARIANT 1034: note = X can be any amino acid
  VARIANT 1036: note = X can be any amino acid except P or G
  VARIANT 1037: note = X can be any amino acid except P or G
  VARIANT 1038: note = X can be any amino acid except P or G
  VARIANT 1040: note = X can be any amino acid
  VARIANT 1041: note = X can be any amino acid
  VARIANT 1042: note = X can be any amino acid
  VARIANT 1044: note = X can be any amino acid except P or G
  VARIANT 1045: note = X can be any amino acid except P or G
  VARIANT 1046: note = X can be any amino acid except P or G
  VARIANT 1048: note = X can be any amino acid
  VARIANT 1049: note = X can be any amino acid
  VARIANT 1050: note = X can be any amino acid
  VARIANT 1052: note = X can be any amino acid except P or G
  VARIANT 1053: note = X can be any amino acid except P or G
  VARIANT 1054: note = X can be any amino acid except P or G
  VARIANT 1056: note = X can be any amino acid
  VARIANT 1057: note = X can be any amino acid
  VARIANT 1058: note = X can be any amino acid
  VARIANT 1060: note = X can be any amino acid except P or G
  VARIANT 1061: note = X can be any amino acid except P or G
  VARIANT 1062: note = X can be any amino acid except P or G
  VARIANT 1064: note = X can be any amino acid
  VARIANT 1065: note = X can be any amino acid
  VARIANT 1066: note = X can be any amino acid
  VARIANT 1068: note = X can be any amino acid except P or G
  VARIANT 1069: note = X can be any amino acid except P or G
  VARIANT 1070: note = X can be any amino acid except P or G
  VARIANT 1072: note = X can be any amino acid
  VARIANT 1073: note = X can be any amino acid
  VARIANT 1074: note = X can be any amino acid
  VARIANT 1076: note = X can be any amino acid except P or G
  VARIANT 1077: note = X can be any amino acid except P or G
  VARIANT 1078: note = X can be any amino acid except P or G
  VARIANT 1080: note = X can be any amino acid
  VARIANT 1081: note = X can be any amino acid
  VARIANT 1082: note = X can be any amino acid
  VARIANT 1084: note = X can be any amino acid except P or G
  VARIANT 1085: note = X can be any amino acid except P or G
  VARIANT 1086: note = X can be any amino acid except P or G
  VARIANT 1088: note = X can be any amino acid
  VARIANT 1089: note = X can be any amino acid
  VARIANT 1090: note = X can be any amino acid
  VARIANT 1092: note = X can be any amino acid except P or G
  VARIANT 1093: note = X can be any amino acid except P or G
  VARIANT 1094: note = X can be any amino acid except P or G
  VARIANT 1096: note = X can be any amino acid
  VARIANT 1097: note = X can be any amino acid
  VARIANT 1098: note = X can be any amino acid
  VARIANT 1100: note = X can be any amino acid except P or G
  VARIANT 1101: note = X can be any amino acid except P or G
  VARIANT 1102: note = X can be any amino acid except P or G
  VARIANT 1104: note = X can be any amino acid
  VARIANT 1105: note = X can be any amino acid
  VARIANT 1106: note = X can be any amino acid
  VARIANT 1108: note = X can be any amino acid except P or G
  VARIANT 1109: note = X can be any amino acid except P or G
  VARIANT 1110: note = X can be any amino acid except P or G
  VARIANT 1112: note = X can be any amino acid
  VARIANT 1113: note = X can be any amino acid
  VARIANT 1114: note = X can be any amino acid
  VARIANT 1116: note = X can be any amino acid except P or G
  VARIANT 1117: note = X can be any amino acid except P or G
  VARIANT 1118: note = X can be any amino acid except P or G
  VARIANT 1120: note = X can be any amino acid
  VARIANT 1121: note = X can be any amino acid
  VARIANT 1122: note = X can be any amino acid
  VARIANT 1124: note = X can be any amino acid except P or G
  VARIANT 1125: note = X can be any amino acid except P or G
  VARIANT 1126: note = X can be any amino acid except P or G
  VARIANT 1128: note = X can be any amino acid
  VARIANT 1129: note = X can be any amino acid
  VARIANT 1130: note = X can be any amino acid
  VARIANT 1132: note = X can be any amino acid except P or G
  VARIANT 1133: note = X can be any amino acid except P or G
  VARIANT 1134: note = X can be any amino acid except P or G
  VARIANT 1136: note = X can be any amino acid
  VARIANT 1137: note = X can be any amino acid
  VARIANT 1138: note = X can be any amino acid
  VARIANT 1140: note = X can be any amino acid except P or G
  VARIANT 1141: note = X can be any amino acid except P or G
  VARIANT 1142: note = X can be any amino acid except P or G
  VARIANT 1144: note = X can be any amino acid
  VARIANT 1145: note = X can be any amino acid
  VARIANT 1146: note = X can be any amino acid
  VARIANT 1148: note = X can be any amino acid except P or G
  VARIANT 1149: note = X can be any amino acid except P or G
  VARIANT 1150: note = X can be any amino acid except P or G
  VARIANT 1152: note = X can be any amino acid
  VARIANT 1153: note = X can be any amino acid
  VARIANT 1154: note = X can be any amino acid
  VARIANT 1156: note = X can be any amino acid except P or G
  VARIANT 1157: note = X can be any amino acid except P or G
  VARIANT 1158: note = X can be any amino acid except P or G
  VARIANT 1160: note = X can be any amino acid
  VARIANT 1161: note = X can be any amino acid
  VARIANT 1162: note = X can be any amino acid
  VARIANT 1164: note = X can be any amino acid except P or G
  VARIANT 1165: note = X can be any amino acid except P or G
  VARIANT 1166: note = X can be any amino acid except P or G
  VARIANT 1168: note = X can be any amino acid
  VARIANT 1169: note = X can be any amino acid
  VARIANT 1170: note = X can be any amino acid
  VARIANT 1172: note = X can be any amino acid except P or G
  VARIANT 1173: note = X can be any amino acid except P or G
  VARIANT 1174: note = X can be any amino acid except P or G
  VARIANT 1176: note = X can be any amino acid
  VARIANT 1177: note = X can be any amino acid
  VARIANT 1178: note = X can be any amino acid
  VARIANT 1180: note = X can be any amino acid except P or G
  VARIANT 1181: note = X can be any amino acid except P or G
  VARIANT 1182: note = X can be any amino acid except P or G
  VARIANT 1184: note = X can be any amino acid
  VARIANT 1185: note = X can be any amino acid
  VARIANT 1186: note = X can be any amino acid
  VARIANT 1188: note = X can be any amino acid except P or G
  VARIANT 1189: note = X can be any amino acid except P or G
  VARIANT 1190: note = X can be any amino acid except P or G
  VARIANT 1192: note = X can be any amino acid
  VARIANT 1193: note = X can be any amino acid
  VARIANT 1194: note = X can be any amino acid
  VARIANT 1196: note = X can be any amino acid except P or G
  VARIANT 1197: note = X can be any amino acid except P or G
  VARIANT 1198: note = X can be any amino acid except P or G
  VARIANT 1200: note = X can be any amino acid
  VARIANT 1201: note = X can be any amino acid
  VARIANT 1202: note = X can be any amino acid
  VARIANT 1204: note = X can be any amino acid except P or G
  VARIANT 1205: note = X can be any amino acid except P or G
  VARIANT 1206: note = X can be any amino acid except P or G
  VARIANT 1208: note = X can be any amino acid
  VARIANT 1209: note = X can be any amino acid
  VARIANT 1210: note = X can be any amino acid
  VARIANT 1212: note = X can be any amino acid except P or G
  VARIANT 1213: note = X can be any amino acid except P or G
  VARIANT 1214: note = X can be any amino acid except P or G
  VARIANT 1216: note = X can be any amino acid
  VARIANT 1217: note = X can be any amino acid
  VARIANT 1218: note = X can be any amino acid
  VARIANT 1220: note = X can be any amino acid except P or G
  VARIANT 1221: note = X can be any amino acid except P or G
  VARIANT 1222: note = X can be any amino acid except P or G
  VARIANT 1224: note = X can be any amino acid
  VARIANT 1225: note = X can be any amino acid
  VARIANT 1226: note = X can be any amino acid
  VARIANT 1228: note = X can be any amino acid except P or G
  VARIANT 1229: note = X can be any amino acid except P or G
  VARIANT 1230: note = X can be any amino acid except P or G
  VARIANT 1232: note = X can be any amino acid
  VARIANT 1233: note = X can be any amino acid
  VARIANT 1234: note = X can be any amino acid
  VARIANT 1236: note = X can be any amino acid except P or G
  VARIANT 1237: note = X can be any amino acid except P or G
  VARIANT 1238: note = X can be any amino acid except P or G
  VARIANT 1240: note = X can be any amino acid
  VARIANT 1241: note = X can be any amino acid
  VARIANT 1242: note = X can be any amino acid
  VARIANT 1244: note = X can be any amino acid except P or G
  VARIANT 1245: note = X can be any amino acid except P or G
  VARIANT 1246: note = X can be any amino acid except P or G
  VARIANT 1248: note = X can be any amino acid
  VARIANT 1249: note = X can be any amino acid
  VARIANT 1250: note = X can be any amino acid
  VARIANT 1252: note = X can be any amino acid except P or G
  VARIANT 1253: note = X can be any amino acid except P or G
  VARIANT 1254: note = X can be any amino acid except P or G
  VARIANT 1256: note = X can be any amino acid
  VARIANT 1257: note = X can be any amino acid
  VARIANT 1258: note = X can be any amino acid
  VARIANT 1260: note = X can be any amino acid except P or G
  VARIANT 1261: note = X can be any amino acid except P or G
  VARIANT 1262: note = X can be any amino acid except P or G
  VARIANT 1264: note = X can be any amino acid
  VARIANT 1265: note = X can be any amino acid
  VARIANT 1266: note = X can be any amino acid
  VARIANT 1268: note = X can be any amino acid except P or G
  VARIANT 1269: note = X can be any amino acid except P or G
  VARIANT 1270: note = X can be any amino acid except P or G
  VARIANT 1272: note = X can be any amino acid
  VARIANT 1273: note = X can be any amino acid
  VARIANT 1274: note = X can be any amino acid
  VARIANT 1276: note = X can be any amino acid except P or G
  VARIANT 1277: note = X can be any amino acid except P or G
  VARIANT 1278: note = X can be any amino acid except P or G
  VARIANT 1280: note = X can be any amino acid
XXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGX

SEQ ID NO: 61 - protein, 1280 aa, synthetic construct
  REGION 1..1280: note = elastin-like polypeptide
  REPEAT 1..8: note = single repeat of (GRGDXPXX)m where m=10-160
  VARIANT 81..1280: note = up to 150 copies of (GRGDXPXX) can be deleted
  SITE 5: note = Q or S
  SITE 7: note = Y or V
  SITE 8: note = Q or S
  SITE 13: note = Q or S
  SITE 15: note = Y or V
  SITE 16: note = Q or S
  SITE 21: note = Q or S
  SITE 23: note = Y or V
  SITE 24: note = Q or S
  SITE 29: note = Q or S
  SITE 31: note = Y or V
  SITE 32: note = Q or S
  SITE 37: note = Q or S
  SITE 39: note = Y or V
  SITE 40: note = Q or S
  SITE 45: note = Q or S
  SITE 47: note = Y or V
  SITE 48: note = Q or S
  SITE 53: note = Q or S
  SITE 55: note = Y or V
  SITE 56: note = Q or S
  SITE 61: note = Q or S
  SITE 63: note = Y or V
  SITE 64: note = Q or S
  SITE 69: note = Q or S
  SITE 71: note = Y or V
  SITE 72: note = Q or S
  SITE 77: note = Q or S
  SITE 79: note = Y or V
  SITE 80: note = Q or S
  SITE 85: note = Q or S
  SITE 87: note = Y or V
  SITE 88: note = Q or S
  SITE 93: note = Q or S
  SITE 95: note = Y or V
  SITE 96: note = Q or S
  SITE 101: note = Q or S
  SITE 103: note = Y or V
  SITE 104: note = Q or S
  SITE 109: note = Q or S
  SITE 111: note = Y or V
  SITE 112: note = Q or S
  SITE 117: note = Q or S
  SITE 119: note = Y or V
  SITE 120: note = Q or S
  SITE 125: note = Q or S
  SITE 127: note = Y or V
  SITE 128: note = Q or S
  SITE 133: note = Q or S
  SITE 135: note = Y or V
  SITE 136: note = Q or S
  SITE 141: note = Q or S
  SITE 143: note = Y or V
  SITE 144: note = Q or S
  SITE 149: note = Q or S
  SITE 151: note = Y or V
  SITE 152: note = Q or S
  SITE 157: note = Q or S
  SITE 159: note = Y or V
  SITE 160: note = Q or S
  SITE 165: note = Q or S
  SITE 167: note = Y or V
  SITE 168: note = Q or S
  SITE 173: note = Q or S
  SITE 175: note = Y or V
  SITE 176: note = Q or S
  SITE 181: note = Q or S
  SITE 183: note = Y or V
  SITE 184: note = Q or S
  SITE 189: note = Q or S
  SITE 191: note = Y or V
  SITE 192: note = Q or S
  SITE 197: note = Q or S
  SITE 199: note = Y or V
  SITE 200: note = Q or S
  SITE 205: note = Q or S
  SITE 207: note = Y or V
  SITE 208: note = Q or S
  SITE 213: note = Q or S
  SITE 215: note = Y or V
  SITE 216: note = Q or S
  SITE 221: note = Q or S
  SITE 223: note = Y or V
  SITE 224: note = Q or S
  SITE 229: note = Q or S
  SITE 231: note = Y or V
  SITE 232: note = Q or S
  SITE 237: note = Q or S
  SITE 239: note = Y or V
  SITE 240: note = Q or S
  SITE 245: note = Q or S
  SITE 247: note = Y or V
  SITE 248: note = Q or S
  SITE 253: note = Q or S
  SITE 255: note = Y or V
  SITE 256: note = Q or S
  SITE 261: note = Q or S
  SITE 263: note = Y or V
  SITE 264: note = Q or S
  SITE 269: note = Q or S
  SITE 271: note = Y or V
  SITE 272: note = Q or S
  SITE 277: note = Q or S
  SITE 279: note = Y or V
  SITE 280: note = Q or S
  SITE 285: note = Q or S
  SITE 287: note = Y or V
  SITE 288: note = Q or S
  SITE 293: note = Q or S
  SITE 295: note = Y or V
  SITE 296: note = Q or S
  SITE 301: note = Q or S
  SITE 303: note = Y or V
  SITE 304: note = Q or S
  SITE 309: note = Q or S
  SITE 311: note = Y or V
  SITE 312: note = Q or S
  SITE 317: note = Q or S
  SITE 319: note = Y or V
  SITE 320: note = Q or S
  SITE 325: note = Q or S
  SITE 327: note = Y or V
  SITE 328: note = Q or S
  SITE 333: note = Q or S
  SITE 335: note = Y or V
  SITE 336: note = Q or S
  SITE 341: note = Q or S
  SITE 343: note = Y or V
  SITE 344: note = Q or S
  SITE 349: note = Q or S
  SITE 351: note = Y or V
  SITE 352: note = Q or S
  SITE 357: note = Q or S
  SITE 359: note = Y or V
  SITE 360: note = Q or S
  SITE 365: note = Q or S
  SITE 367: note = Y or V
  SITE 368: note = Q or S
  SITE 373: note = Q or S
  SITE 375: note = Y or V
  SITE 376: note = Q or S
  SITE 381: note = Q or S
  SITE 383: note = Y or V
  SITE 384: note = Q or S
  SITE 389: note = Q or S
  SITE 391: note = Y or V
  SITE 392: note = Q or S
  SITE 397: note = Q or S
  SITE 399: note = Y or V
  SITE 400: note = Q or S
  SITE 405: note = Q or S
  SITE 407: note = Y or V
  SITE 408: note = Q or S
  SITE 413: note = Q or S
  SITE 415: note = Y or V
  SITE 416: note = Q or S
  SITE 421: note = Q or S
  SITE 423: note = Y or V
  SITE 424: note = Q or S
  SITE 429: note = Q or S
  SITE 431: note = Y or V
  SITE 432: note = Q or S
  SITE 437: note = Q or S
  SITE 439: note = Y or V
  SITE 440: note = Q or S
  SITE 445: note = Q or S
  SITE 447: note = Y or V
  SITE 448: note = Q or S
  SITE 453: note = Q or S
  SITE 455: note = Y or V
  SITE 456: note = Q or S
  SITE 461: note = Q or S
  SITE 463: note = Y or V
  SITE 464: note = Q or S
  SITE 469: note = Q or S
  SITE 471: note = Y or V
  SITE 472: note = Q or S
  SITE 477: note = Q or S
  SITE 479: note = Y or V
  SITE 480: note = Q or S
  SITE 485: note = Q or S
  SITE 487: note = Y or V
  SITE 488: note = Q or S
  SITE 493: note = Q or S
  SITE 495: note = Y or V
  SITE 496: note = Q or S
  SITE 501: note = Q or S
  SITE 503: note = Y or V
  SITE 504: note = Q or S
  SITE 509: note = Q or S
  SITE 511: note = Y or V
  SITE 512: note = Q or S
  SITE 517: note = Q or S
  SITE 519: note = Y or V
  SITE 520: note = Q or S
  SITE 525: note = Q or S
  SITE 527: note = Y or V
  SITE 528: note = Q or S
  SITE 533: note = Q or S
  SITE 535: note = Y or V
  SITE 536: note = Q or S
  SITE 541: note = Q or S
  SITE 543: note = Y or V
  SITE 544: note = Q or S
  SITE 549: note = Q or S
  SITE 551: note = Y or V
  SITE 552: note = Q or S
  SITE 557: note = Q or S
  SITE 559: note = Y or V
  SITE 560: note = Q or S
  SITE 565: note = Q or S
  SITE 567: note = Y or V
  SITE 568: note = Q or S
  SITE 573: note = Q or S
  SITE 575: note = Y or V
  SITE 576: note = Q or S
  SITE 581: note = Q or S
  SITE 583: note = Y or V
  SITE 584: note = Q or S
  SITE 589: note = Q or S
  SITE 591: note = Y or V
  SITE 592: note = Q or S
  SITE 597: note = Q or S
  SITE 599: note = Y or V
  SITE 600: note = Q or S
  SITE 605: note = Q or S
  SITE 607: note = Y or V
  SITE 608: note = Q or S
  SITE 613: note = Q or S
  SITE 615: note = Y or V
  SITE 616: note = Q or S
  SITE 621: note = Q or S
  SITE 623: note = Y or V
  SITE 624: note = Q or S
  SITE 629: note = Q or S
  SITE 631: note = Y or V
  SITE 632: note = Q or S
  SITE 637: note = Q or S
  SITE 639: note = Y or V
  SITE 640: note = Q or S
  SITE 645: note = Q or S
  SITE 647: note = Y or V
  SITE 648: note = Q or S
  SITE 653: note = Q or S
  SITE 655: note = Y or V
  SITE 656: note = Q or S
  SITE 661: note = Q or S
  SITE 663: note = Y or V
  SITE 664: note = Q or S
  SITE 669: note = Q or S
  SITE 671: note = Y or V
  SITE 672: note = Q or S
  SITE 677: note = Q or S
  SITE 679: note = Y or V
  SITE 680: note = Q or S
  SITE 685: note = Q or S
  SITE 687: note = Y or V
  SITE 688: note = Q or S
  SITE 693: note = Q or S
  SITE 695: note = Y or V
  SITE 696: note = Q or S
  SITE 701: note = Q or S
  SITE 703: note = Y or V
  SITE 704: note = Q or S
  SITE 709: note = Q or S
  SITE 711: note = Y or V
  SITE 712: note = Q or S
  SITE 717: note = Q or S
  SITE 719: note = Y or V
  SITE 720: note = Q or S
  SITE 725: note = Q or S
  SITE 727: note = Y or V
  SITE 728: note = Q or S
  SITE 733: note = Q or S
  SITE 735: note = Y or V
  SITE 736: note = Q or S
  SITE 741: note = Q or S
  SITE 743: note = Y or V
  SITE 744: note = Q or S
  SITE 749: note = Q or S
  SITE 751: note = Y or V
  SITE 752: note = Q or S
  SITE 757: note = Q or S
  SITE 759: note = Y or V
  SITE 760: note = Q or S
  SITE 765: note = Q or S
  SITE 767: note = Y or V
  SITE 768: note = Q or S
  SITE 773: note = Q or S
  SITE 775: note = Y or V
  SITE 776: note = Q or S
  SITE 781: note = Q or S
  SITE 783: note = Y or V
  SITE 784: note = Q or S
  SITE 789: note = Q or S
  SITE 791: note = Y or V
  SITE 792: note = Q or S
  SITE 797: note = Q or S
  SITE 799: note = Y or V
  SITE 800: note = Q or S
  SITE 805: note = Q or S
  SITE 807: note = Y or V
  SITE 808: note = Q or S
  SITE 813: note = Q or S
  SITE 815: note = Y or V
  SITE 816: note = Q or S
  SITE 821: note = Q or S
  SITE 823: note = Y or V
  SITE 824: note = Q or S
  SITE 829: note = Q or S
  SITE 831: note = Y or V
  SITE 832: note = Q or S
  SITE 837: note = Q or S
  SITE 839: note = Y or V
  SITE 840: note = Q or S
  SITE 845: note = Q or S
  SITE 847: note = Y or V
  SITE 848: note = Q or S
  SITE 853: note = Q or S
  SITE 855: note = Y or V
  SITE 856: note = Q or S
  SITE 861: note = Q or S
  SITE 863: note = Y or V
  SITE 864: note = Q or S
  SITE 869: note = Q or S
  SITE 871: note = Y or V
  SITE 872: note = Q or S
  SITE 877: note = Q or S
  SITE 879: note = Y or V
  SITE 880: note = Q or S
  SITE 885: note = Q or S
  SITE 887: note = Y or V
  SITE 888: note = Q or S
  SITE 893: note = Q or S
  SITE 895: note = Y or V
  SITE 896: note = Q or S
  SITE 901: note = Q or S
  SITE 903: note = Y or V
  SITE 904: note = Q or S
  SITE 909: note = Q or S
  SITE 911: note = Y or V
  SITE 912: note = Q or S
  SITE 917: note = Q or S
  SITE 919: note = Y or V
  SITE 920: note = Q or S
  SITE 925: note = Q or S
  SITE 927: note = Y or V
  SITE 928: note = Q or S
  SITE 933: note = Q or S
  SITE 935: note = Y or V
  SITE 936: note = Q or S
  SITE 941: note = Q or S
  SITE 943: note = Y or V
  SITE 944: note = Q or S
  SITE 949: note = Q or S
  SITE 951: note = Y or V
  SITE 952: note = Q or S
  SITE 957: note = Q or S
  SITE 959: note = Y or V
  SITE 960: note = Q or S
  SITE 965: note = Q or S
  SITE 967: note = Y or V
  SITE 968: note = Q or S
  SITE 973: note = Q or S
  SITE 975: note = Y or V
  SITE 976: note = Q or S
  SITE 981: note = Q or S
  SITE 983: note = Y or V
  SITE 984: note = Q or S
  SITE 989: note = Q or S
  SITE 991: note = Y or V
  SITE 992: note = Q or S
  SITE 997: note = Q or S
  SITE 999: note = Y or V
  SITE 1000: note = Q or S
  SITE 1005: note = Q or S
  SITE 1007: note = Y or V
  SITE 1008: note = Q or S
  SITE 1013: note = Q or S
  SITE 1015: note = Y or V
  SITE 1016: note = Q or S
  SITE 1021: note = Q or S
  SITE 1023: note = Y or V
  SITE 1024: note = Q or S
  SITE 1029: note = Q or S
  SITE 1031: note = Y or V
  SITE 1032: note = Q or S
  SITE 1037: note = Q or S
  SITE 1039: note = Y or V
  SITE 1040: note = Q or S
  SITE 1045: note = Q or S
  SITE 1047: note = Y or V
  SITE 1048: note = Q or S
  SITE 1053: note = Q or S
  SITE 1055: note = Y or V
  SITE 1056: note = Q or S
  SITE 1061: note = Q or S
  SITE 1063: note = Y or V
  SITE 1064: note = Q or S
  SITE 1069: note = Q or S
  SITE 1071: note = Y or V
  SITE 1072: note = Q or S
  SITE 1077: note = Q or S
  SITE 1079: note = Y or V
  SITE 1080: note = Q or S
  SITE 1085: note = Q or S
  SITE 1087: note = Y or V
  SITE 1088: note = Q or S
  SITE 1093: note = Q or S
  SITE 1095: note = Y or V
  SITE 1096: note = Q or S
  SITE 1101: note = Q or S
  SITE 1103: note = Y or V
  SITE 1104: note = Q or S
  SITE 1109: note = Q or S
  SITE 1111: note = Y or V
  SITE 1112: note = Q or S
  SITE 1117: note = Q or S
  SITE 1119: note = Y or V
  SITE 1120: note = Q or S
  SITE 1125: note = Q or S
  SITE 1127: note = Y or V
  SITE 1128: note = Q or S
  SITE 1133: note = Q or S
  SITE 1135: note = Y or V
  SITE 1136: note = Q or S
  SITE 1141: note = Q or S
  SITE 1143: note = Y or V
  SITE 1144: note = Q or S
  SITE 1149: note = Q or S
  SITE 1151: note = Y or V
  SITE 1152: note = Q or S
  SITE 1157: note = Q or S
  SITE 1159: note = Y or V
  SITE 1160: note = Q or S
  SITE 1165: note = Q or S
  SITE 1167: note = Y or V
  SITE 1168: note = Q or S
  SITE 1173: note = Q or S
  SITE 1175: note = Y or V
  SITE 1176: note = Q or S
  SITE 1181: note = Q or S
  SITE 1183: note = Y or V
  SITE 1184: note = Q or S
  SITE 1189: note = Q or S
  SITE 1191: note = Y or V
  SITE 1192: note = Q or S
  SITE 1197: note = Q or S
  SITE 1199: note = Y or V
  SITE 1200: note = Q or S
  SITE 1205: note = Q or S
  SITE 1207: note = Y or V
  SITE 1208: note = Q or S
  SITE 1213: note = Q or S
  SITE 1215: note = Y or V
  SITE 1216: note = Q or S
  SITE 1221: note = Q or S
  SITE 1223: note = Y or V
  SITE 1224: note = Q or S
  SITE 1229: note = Q or S
  SITE 1231: note = Y or V
  SITE 1232: note = Q or S
  SITE 1237: note = Q or S
  SITE 1239: note = Y or V
  SITE 1240: note = Q or S
  SITE 1245: note = Q or S
  SITE 1247: note = Y or V
  SITE 1248: note = Q or S
  SITE 1253: note = Q or S
  SITE 1255: note = Y or V
  SITE 1256: note = Q or S
  SITE 1261: note = Q or S
  SITE 1263: note = Y or V
  SITE 1264: note = Q or S
  SITE 1269: note = Q or S
  SITE 1271: note = Y or V
  SITE 1272: note = Q or S
  SITE 1277: note = Q or S
  SITE 1279: note = Y or V
  SITE 1280: note = Q or S
GRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXX

SEQ ID NO: 62 - protein, 365 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKVAAPNLSRMGAIPVMIPAQSKDGSIV

SEQ ID NO: 63 - protein, 219 aa, Homo sapiens
MLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAG

SEQ ID NO: 64 - protein, 122 aa, Homo sapiens
MITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPS

SEQ ID NO: 65 - protein, 116 aa, Homo sapiens
MLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIH

SEQ ID NO: 66 - protein, 89 aa, Homo sapiens
MPSGARCYVDGSEEIGSDFKIKCEPKEGSLPLQYEWQKLSDSQKMPTSWLAEMTSSVISVKNASSEYSGTYSCTVRNRVGSDQCLLRLN

SEQ ID NO: 67 - protein, 219 aa, Homo sapiens
MLSITTPEEMIEKAKGETAYLPCKFTLSPEDQGPLDIEWLISPADNQKVDQVGRCATSKEPYVHCQKLHRQRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAG

SEQ ID NO: 68 - protein, 182 aa, Homo sapiens
MLSITTPEEMIEKAKGETAYLPCKFTLSPEDQGPLDIEWLISPADNQKVDQVGRCATSKEPYVHCQKLHRQRVHFTSNDLKSGDASINVTNLQLSDIGTYQCKVKKAPGVANKKIHLVVLGKMCHLQRAVRPLPEATSAVIIHPWGPCLLPTWKDIPRLSITKYQVKTLNALLRVRLSHLLR

SEQ ID NO: 69 - protein, 235 aa, Homo sapiens
MLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEGKMCHLQRAVRPLPEATSAVIIHPWGPCLLPTWKDIPRLSITKYQVKTLNALLRVRLSHLLR

SEQ ID NO: 70 - protein, 178 aa, Homo sapiens
MLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAASNKAG

SEQ ID NO: 71 - protein, 185 aa, synthetic construct
  REGION 1..185: note = AdPep
  REPEAT 2..24: note = single repeat of (RAIVFRVQWLRRYFVNGSRSGGG)n where; n = 1-8
  VARIANT 25..185: note = up to 7 copies of (RAIVFRVQWLRRYFVNGSRSGGG) can be deleted
MRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGG

SEQ ID NO: 72 - protein, 184 aa, synthetic construct
  REGION 1..184: note = AdPep
  REPEAT 1..23: note = single repeat of (RAIVFRVQWLRRYFVNGSRSGGG)n where; n = 1-8
  VARIANT 24..184: note = up to 7 copies of (RAIVFRVQWLRRYFVNGSRSGGG) can be deleted
RAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGG

SEQ ID NO: 73 - protein, 860 aa, Homo sapiens [sequence omitted]

SEQ ID NO: 74 - protein, 768 aa, Homo sapiens
MAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVR

SEQ ID NO: 75 - protein, 40 aa, Homo sapiens
MSVTCKSGDFSCGGRVNRCIPQFWRCDGQVDCDNGSDEQG

SEQ ID NO: 76 - protein, 38 aa, Homo sapiens
MTCSQDEFRCHDGKCISRQFVCDSDRDCLDGSDEASCP

SEQ ID NO: 77 - protein, 330 aa, Homo sapiens
MSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACK

SEQ ID NO: 78 - protein, 458 aa, Homo sapiens
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 79 - protein, 372 aa, Homo sapiens
MKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 80 - protein, 179 aa, Homo sapiens
MKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLA

SEQ ID NO: 81 - protein, 101 aa, Homo sapiens
MKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGL

SEQ ID NO: 82 - protein, 392 aa, Homo sapiens [sequence omitted]

SEQ ID NO: 83 - protein, 310 aa, Homo sapiens
MCEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGPRPTYKPPVSNYPGYPKPEEGILDSLD

SEQ ID NO: 84 - protein, 359 aa, Homo sapiens
MCEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGPRPTYKPPVSNYPGYPKPEEGILDSLDVWVIAVIVIAIVVGVAVICVVPYRYLQRRKKKGTYLTDETHREVKFTSL

SEQ ID NO: 85 - protein, 63 aa, Homo sapiens
MCEEPPTFEAMELIGKPKPYYEIGERVDYKCKKGYFYIPPLATHTICDRNHTWLPVSDDACYR

SEQ ID NO: 86 - protein, 64 aa, Homo sapiens
METCPYIRDPLNGQAVPANGTYEFGYQMHFICNEGYYLIGEEILYCELKGSVAIWSGKPPICEK

SEQ ID NO: 87 - protein, 67 aa, Homo sapiens
MVLCTPPPKIKNGKHTFSEVEVFEYLDAVTYSCDPAPGPDPFSLIGESTIYCGDNSVWSRAAPECKV

SEQ ID NO: 88 - protein, 61 aa, Homo sapiens
MVKCRFPVVENGKQISGFGKKFYYKATVMFECDKGFYLDGSDTIVCDSNSTWDPPVPKCLK

SEQ ID NO: 89 - protein, 26 aa, Homo sapiens
MSTSSTTKSPASSASGPRPTYKPPVS

SEQ ID NO: 90 - protein, 335 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGPLQKKLDSFPAQDPCTTIYVAATEPVPESVQETNSITVYASVTLPES

SEQ ID NO: 91 - protein, 218 aa, Homo sapiens
MASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKP

SEQ ID NO: 92 - protein, 213 aa, Homo sapiens
ASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPS

SEQ ID NO: 93 - protein, 510 aa, Homo sapiens
MPLSLGAEMWGPEAWLLLLLLLASFTGRCPAGELETSDVVTVVLGQDAKLPCFYRGDSGEQVGQVAWARVDAGEGAQELALLHSKYGLHVSPAYEGRVEQPPPPRNPLDGSVLLRNAVQADEGEYECRVSTFPAGSFQARLRLRVLVPPLPSLNPGPALEEGQGLTLAASCTAEGSPAPSVTWDTEVKGTTSSRSFKHSRSAAVTSEFHLVPSRSMNGQPLTCVVSHPGLLQDQRITHILHVSFLAEASVRGLEDQNLWHIGREGAMLKCLSEGQPPPSYNWTRLDGPLPSGVRVDGDTLGFPPLTTEHSGIYVCHVSNEFSSRDSQVTVDVLDPQEDSGKQVDLVSASVVVVGVIAALLFCLLVVVVVLMSRYHRRKAQQMTQKYEEELTLTRENSIRRLHSHHTDPRSQPEESVGLRAEGHPDSLKDNSSCSVMSEEPEGRSYSTLTTVREIETQTELLSPGSGRAEEEEDQDEGIKQAMNHFVQENGTLRAKPTGNGIYINGRGHLV

SEQ ID NO: 94 - protein, 319 aa, Homo sapiens
MGELETSDVVTVVLGQDAKLPCFYRGDSGEQVGQVAWARVDAGEGAQELALLHSKYGLHVSPAYEGRVEQPPPPRNPLDGSVLLRNAVQADEGEYECRVSTFPAGSFQARLRLRVLVPPLPSLNPGPALEEGQGLTLAASCTAEGSPAPSVTWDTEVKGTTSSRSFKHSRSAAVTSEFHLVPSRSMNGQPLTCVVSHPGLLQDQRITHILHVSFLAEASVRGLEDQNLWHIGREGAMLKCLSEGQPPPSYNWTRLDGPLPSGVRVDGDTLGFPPLTTEHSGIYVCHVSNEFSSRDSQVTVDVLDPQEDSGKQVDLVSAS

SEQ ID NO: 95 - protein, 113 aa, Homo sapiens
GELETSDVVTVVLGQDAKLPCFYRGDSGEQVGQVAWARVDAGEGAQELALLHSKYGLHVSPAYEGRVEQPPPPRNPLDGSVLLRNAVQADEGEYECRVSTFPAGSFQARLRLR

SEQ ID NO: 96 - protein, 91 aa, Homo sapiens
MPPLPSLNPGPALEEGQGLTLAASCTAEGSPAPSVTWDTEVKGTTSSRSFKHSRSAAVTSEFHLVPSRSMNGQPLTCVVSHPGLLQDQRIT

SEQ ID NO: 97 - protein, 85 aa, Homo sapiens
MASVRGLEDQNLWHIGREGAMLKCLSEGQPPPSYNWTRLDGPLPSGVRVDGDTLGFPPLTTEHSGIYVCHVSNEFSSRDSQVTVD

SEQ ID NO: 98 - protein, 288 aa, Homo sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 99 - protein, 209 aa, Homo sapiens
MVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 100 - protein, 201 aa, Homo sapiens
MVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTT

SEQ ID NO: 101 - protein, 329 aa, Homo sapiens
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 102 - protein, 225 aa, Homo sapiens
MAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 103 - protein, 154 aa, Homo sapiens
MYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSI

SEQ ID NO: 104 - protein, 116 aa, Homo sapiens
MLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 105 - protein, 541 aa, Homo sapiens
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 106 - protein, 14 aa, Homo sapiens
MGPERLSAFVFPGE

SEQ ID NO: 107 - protein, 72 aa, Homo sapiens
MQPGAASAAINASVGAAGSAENAPSKEVLDSFLDLARNIFPSNLVSAAFRSYSTTYEERNITGTRVKVPVGQ

SEQ ID NO: 108 - protein, 22 aa, Homo sapiens
MAGKIVEMEDVGLLFARLGKYI

SEQ ID NO: 109 - protein, 14 aa, Homo sapiens
MIAQLSQQSLDFVK

SEQ ID NO: 110 - protein, 14 aa, Homo sapiens
MLPVDHISLILAVD

SEQ ID NO: 111 - protein, 532 aa, Homo sapiens
MEKSNETNGYLDSAQAGPAAGPGAPGTAAGRARRCAGFLRRQALVLLTVSGVLAGAGLGAALRGLSLSRTQVTYLAFPGEMLLRMLRMIILPLVVCSLVSGAASLDASCLGRLGGIAVAYFGLTTLSASALAVALAFIIKPGSGAQTLQSSDLGLEDSGPPPVPKETVDSFLDLARNLFPSNLVVAAFRTYATDYKVVTQNSSSGNVTHEKIPIGTEIEGMNILGLVLFALVLGVALKKLGSEGEDLIRFFNSLNEATMVLVSWIMWYVPVGIMFLVGSKIVEMKDIIVLVTSLGKYIFASILGHVIHGGIVLPLIYFVFTRKNPFRFLLGLLAPFATAFATCSSSATLPSMMKCIEENNGVDKRISRFILPIGATVNMDGAAIFQCVAAVFIAQLNNVELNAGQIFTILVTATASSVGAAGVPAGGVLTIAIILEAIGLPTHDLPLILAVDWIVDRTTTVVNVEGDALGAGILHHLNQKATKKGEQELAEVKVEAIPNCKSEEETSPLVTHQNPAGPVASAPELESKESVL

SEQ ID NO: 112 - protein, 78 aa, Homo sapiens
MKPGSGAQTLQSSDLGLEDSGPPPVPKETVDSFLDLARNLFPSNLVVAAFRTYATDYKVVTQNSSSGNVTHEKIPIGT

SEQ ID NO: 113 - protein, 46 aa, Homo sapiens
MNILGLVLFALVLGVALKKLGSEGEDLIRFFNSLNEATMVLVSWIM

SEQ ID NO: 114 - protein, 333 aa, Homo sapiens
MAVRRDSVWKYCWGVLMVLCRTAISKSIVLEPIYWNSSNSKFLPGQGLVLYPQIGDKLDIICPKVDSKTVGQYEYYKVYMVDKDQADRCTIKKENTPLLNCAKPDQDIKFTIKFQEFSPNLWGLEFQKNKDYYIISTSNGSLEGLDNQEGGVCQTRAMKILMKVGQDASSAGSTRNKDPTRRPELEAGTNGRSSTTSPFVKPNPGSSTDGNSAGHSGNNILGSEVALFAGIASGCIIFIVIIITLVVLLLKYRRRHRKHSPQHTTTLSLSTLATPKRSGNNNGSEPSDIIIPLRTADSVFCPHYEKVSGDYGHPVYIVQEMPPQSPANIYYKV

SEQ ID NO: 115 - protein, 203 aa, Homo sapiens
MIVLEPIYWNSSNSKFLPGQGLVLYPQIGDKLDIICPKVDSKTVGQYEYYKVYMVDKDQADRCTIKKENTPLLNCAKPDQDIKFTIKFQEFSPNLWGLEFQKNKDYYIISTSNGSLEGLDNQEGGVCQTRAMKILMKVGQDASSAGSTRNKDPTRRPELEAGTNGRSSTTSPFVKPNPGSSTDGNSAGHSGNNILGSEVALFA

SEQ ID NO: 116 - protein, 679 aa, Homo sapiens
MATLITSTTAATAASGPLVDYLWMLILGFIIAFVLAFSVGANDVANSFGTAVGSGVVTLKQACILASIFETVGSVLLGAKVSETIRKGLIDVEMYNSTQGLLMAGSVSAMFGSAVWQLVASFLKLPISGTHCIVGATIGFSLVAKGQEGVKWSELIKIVMSWFVSPLLSGIMSGILFFLVRAFILHKADPVPNGLRALPVFYACTVGINLFSIMYTGAPLLGFDKLPLWGTILISVGCAVFCALIVWFFVCPRMKRKIEREIKCSPSESPLMEKKNSLKEDHEETKLSVGDIENKHPVSEVGPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 117 - protein, 28 aa, Homo sapiens
MGNDVSNAIGPLVALYLVYDTGDVSSKV

SEQ ID NO: 118 - protein, 10 aa, Homo sapiens
MIFRYVILRM

SEQ ID NO: 119 - protein, 652 aa, Homo sapiens
MAMDEYLWMVILGFIIAFILAFSVGANDVANSFGTAVGSGVVTLRQACILASIFETTGSVLLGAKVGETIRKGIIDVNLYNETVETLMAGEVSAMVGSAVWQLIASFLRLPISGTHCIVGSTIGFSLVAIGTKGVQWMELVKIVASWFISPLLSGFMSGLLFVLIRIFILKKEDPVPNGLRALPVFYAATIAINVFSIMYTGAPVLGLVLPMWAIALISFGVALLFAFFVWLFVCPWMRRKITGKLQKEGALSRVSDESLSKVQEAESPVFKELPGAKANDDSTIPLTGAAGETLGTSEGTSAGSHPRAAYGRALSMTHGSVKSPISNGTFGFDGHTRSDGHVYHTVHKDSGLYKDLLHKIHIDRGPEEKPAQESNYRLLRRNNSYTCYTAAICGLPVHATFRAADSSAPEDSEKLVGDTVSYSKKRLRYDSYSSYCNAVAEAEIEAEEGGVEMKLASELADPDQPREDPAEEEKEEKDAPEVHLLFHFLQVLTACFGSFAHGGNDVSNAIGPLVALWLIYKQGGVTQEAATPVWLLFYGGVGICTGLWVWGRRVIQTMGKDLTPITPSSGFTIELASAFTVVIASNIGLPVSTTHCKVGSVVAVGWIRSRKAVDWRLFRNIFVAWFVTVPVAGLFSAAVMALLMYGILPYV

SEQ ID NO: 120 - protein, 28 aa, Homo sapiens
MGNDVSNAIGPLVALWLIYKQGGVTQEA

SEQ ID NO: 121 - protein, 805 aa, Homo sapiens [sequence omitted]

SEQ ID NO: 122 - protein, 724 aa, Homo sapiens
MQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVS

SEQ ID NO: 123 - protein, 598 aa, Homo sapiens
MSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYAD

SEQ ID NO: 124 - protein, 102 aa, Homo sapiens
MSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTI

SEQ ID NO: 125 - protein, 48 aa, synthetic construct
  REGION 1..48: note = Albumin-binding polypeptide
MLAEAKVLANRELDKYGVSDFYKRLINKAKTVEGVEALKLHLLAALPG

SEQ ID NO: 126 - protein, 253 aa, Staphylococcus aureus
MAAQHDEAQQNAFYQVLNMPNLNADQRNGFIQSLKDDPSQSANVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDGN

SEQ ID NO: 127 - protein, 59 aa, Staphylococcus aureus
MADNKFNKEQQNAFYEILHLPNLNEEQRNGFIQSLKDDPSQSANLLAEAKKLNDAQAPK

SEQ ID NO: 128 - protein, 59 aa, Staphylococcus aureus
MADNKFNKEQQNAFYEILHLPNLTEEQRNGFIQSLKDDPSVSKEILAEAKKLNDAQAPK

SEQ ID NO: 129 - protein, 992 aa, Finegoldia magna
MKINKKLLMAALAGAIVVGGGANAYAAEEDNTDNNLSMDEISDAYFDYHGDVSDSVDPVEEEIDEALAKALAEAKETAKKHIDSLNHLSETAKKLAKNDIDSATTINAINDIVARADVMERKTAEKEEAEKLAAAKETAKKHIDELKHLADKTKELAKRDIDSATTINAINDIVARADVMERKTAEKEEAEKLAAAKETAKKHIDELKHLADKTKELAKRDIDSATTIDAINDIVARADVMERKLSEKETPEPEEEVTIKANLIFADGSTQNAEFKGTFAKAVSDAYAYADALKKDNGEYTVDVADKGLTLNIKFAGKKEKPEEPKEEVTIKVNLIFADGKTQTAEFKGTFEEATAKAYAYADLLAKENGEYTADLEDGGNTINIKFAGKETPETPEEPKEEVTIKVNLIFADGKIQTAEFKGTFEEATAKAYAYANLLAKENGEYTADLEDGGNTINIKFAGKETPETPEEPKEEVTIKVNLIFADGKTQTAEFKGTFEEATAEAYRYADLLAKVNGEYTADLEDGGYTINIKFAGKEQPGENPGITIDEWLLKNAKEEAIKELKEAGITSDLYFSLINKAKTVEGVEALKNEILKAHAGEETPELKDGYATYEEAEAAAKEALKNDDVNNAYEIVQGADGRYYYVLKIEVADEEEPGEDTPEVQEGYATYEEAEAAAKEALKEDKVNNAYEVVQGADGRYYYVLKIEDKEDEQPGEEPGENPGITIDEWLLKNAKEDAIKELKEAGISSDIYFDAINKAKTVEGVEALKNEILKAHAEKPGENPGITIDEWLLKNAKEAAIKELKEAGITAEYLFNLINKAKTVEGVESLKNEILKAHAEKPGENPGITIDEWLLKNAKEDAIKELKEAGITSDIYFDAINKAKTIEGVEALKNEILKAHKKDEEPGKKPGEDKKPEDKKPGEDKKPEDKKPGEDKKPEDKKPGKTDKDSPNKKKKAKLPKAGSEAEILTLAAAALSTAAGAYVSLKKRK

SEQ ID NO: 130 - protein, 75 aa, Finegoldia magna
MKEEVTIKVNLIFADGKTQTAEFKGTFEEATAKAYAYADLLAKENGEYTADLEDGGNTINIKFAGKETPETPEEP

SEQ ID NO: 131 - protein, 593 aa, unidentified
  REGION 1..593: note = Streptococcus sp. group G
MEKEKKVKYFLRKSAFGLASVSAAFLVGSTVFAVDSPIEDTPIIRNGGELTNLLGNSETTLALRNEESATADLTAAAVADTVAAAAAENAGAAAWEAAAAADALAKAKADALKEFNKYGVSDYYKNLINNAKTVEGVKDLQAQVVESAKKARISEATDGLSDFLKSQTPAEDTVKSIELAEAKVLANRELDKYGVSDYHKNLINNAKTVEGVKDLQAQVVESAKKARISEATDGLSDFLKSQTPAEDTVKSIELAEAKVLANRELDKYGVSDYYKNLINNAKTVEGVKALIDEILAALPKTDTYKLILNGKTLKGETTTEAVDAATAEKVFKQYANDNGVDGEWTYDDATKTFTVTEKPEVIDASELTPAVTTYKLVINGKTLKGETTTEAVDAATAEKVFKQYANDNGVDGEWTYDDATKTFTVTEKPEVIDASELTPAVTTYKLVINGKTLKGETTTKAVDAETAEKAFKQYANDNGVDGVWTYDDATKTFTVTEMVTEVPGDAPTEPEKPEASIPLVPLTPATPIAKDDAKKDDTKKEDAKKPEAKKEDAKKAETLPTTGEGSNPFFTAAALAVMAGAGALAVASKRKED

SEQ ID NO: 132 - protein, 530 aa, unidentified
  REGION 1..530: note = Streptococcus sp. group G
MVDSPIEDTPIIRNGGELTNLLGNSETTLALRNEESATADLTAAAVADTVAAAAAENAGAAAWEAAAAADALAKAKADALKEFNKYGVSDYYKNLINNAKTVEGVKDLQAQVVESAKKARISEATDGLSDFLKSQTPAEDTVKSIELAEAKVLANRELDKYGVSDYHKNLINNAKTVEGVKDLQAQVVESAKKARISEATDGLSDFLKSQTPAEDTVKSIELAEAKVLANRELDKYGVSDYYKNLINNAKTVEGVKALIDEILAALPKTDTYKLILNGKTLKGETTTEAVDAATAEKVFKQYANDNGVDGEWTYDDATKTFTVTEKPEVIDASELTPAVTTYKLVINGKTLKGETTTEAVDAATAEKVFKQYANDNGVDGEWTYDDATKTFTVTEKPEVIDASELTPAVTTYKLVINGKTLKGETTTKAVDAETAEKAFKQYANDNGVDGVWTYDDATKTFTVTEMVTEVPGDAPTEPEKPEASIPLVPLTPATPIAKDDAKKDDTKKEDAKKPEAKKEDAKKAETLPTT

SEQ ID NO: 133 - protein, 72 aa, unidentified
  REGION 1..72: note = Streptococcus sp. group G
TYKLILNGKTLKGETTTEAVDAATAEKVFKQYANDNGVDGEWTYDDATKTFTVTEKPEVIDASELTPAVTTY

SEQ ID NO: 134 - protein, 494 aa, Homo sapiens
MSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPDSLSDRDSYLSGSLSSGSLSGSESPSLDPGRRLPIFSRLSISDD

SEQ ID NO: 135 - protein, 71 aa, Homo sapiens
MSTRYKTELCRPFEESGTCKYGEKCQFAHGFHELRSLTRHPKYKTELCRTFHTIGFCPYGPRCHFIHNADE

SEQ ID NO: 136 - protein, 43 aa, Homo sapiens
MYGEKCQFAHGFHELRSLTRHPKYKTELCRTFHTIGFCPYGPR

SEQ ID NO: 137 - protein, 217 aa, Homo sapiens [sequence omitted]

SEQ ID NO: 138 - protein, 183 aa, Homo sapiens
MKHPLQNRWALWFFKNDKSKTWQANLRLISKFDTVEDFWALYNHIQLSSNLMPGCDYSLFKDGIEPMWEDEKNKRGGRWLITLNKQQRRSDLDRFWLETLLCLIGESFDDYSDDVCGAVVNVRAKGDKIAIWTTECENREAVTHIGRVYKERLGLPPKIVIGYQSHADTATKSGSTTKNRFVV

SEQ ID NO: 139 - protein, 636 aa, Homo sapiens
MNPSAPSYPMASLYVGDLHPDVTEAMLYEKFSPAGPILSIRVCRDMITRRSLGYAYVNFQQPADAERALDTMNFDVIKGKPVRIMWSQRDPSLRKSGVGNIFIKNLDKSIDNKALYDTFSAFGNILSCKVVCDENGSKGYGFVHFETQEAAERAIEKMNGMLLNDRKVFVGRFKSRKEREAELGARAKEFTNVYIKNFGEDMDDERLKDLFGKFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRKEERQAHLTNQYMQRMASVRAVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRTVPQYKYAAGVRNPQQHLNAQPQVTMQQPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 140 - protein, 174 aa, Homo sapiens
MSYPMASLYVGDLHPDVTEAMLYEKFSPAGPILSIRVCRDMITRRSLGYAYVNFQQPADAERALDTMNFDVIKGKPVRIMWSQRDPSLRKSGVGNIFIKNLDKSIDNKALYDTFSAFGNILSCKVVCDENGSKGYGFVHFETQEAAERAIEKMNGMLLNDRKVFVGRFKSRKER

SEQ ID NO: 141 - protein, 80 aa, Homo sapiens
MASLYVGDLHPDVTEAMLYEKFSPAGPILSIRVCRDMITRRSLGYAYVNFQQPADAERALDTMNFDVIKGKPVRIMWSQR

SEQ ID NO: 142 - protein, 78 aa, Homo sapiens
MGNIFIKNLDKSIDNKALYDTFSAFGNILSCKVVCDENGSKGYGFVHFETQEAAERAIEKMNGMLLNDRKVFVGRFKS

SEQ ID NO: 143 - protein, 79 aa, Homo sapiens
MTNVYIKNFGEDMDDERLKDLFGKFGPALSVKVMTDESGKSKGFGFVSFERHEDAQKAVDEMNGKELNGKQIYVGRAQK

SEQ ID NO: 144 - protein, 78 aa, Homo sapiens
MVNLYVKNLDDGIDDERLRKEFSPFGTITSAKVMMEGGRSKGFGFVCFSSPEEATKAVTEMNGRIVATKPLYVALAQR

SEQ ID NO: 145 - protein, 429 aa, Homo sapiens
MAQAPADPGREGHLEQRILQVLTEAGSPVKLAQLVKECQAPKRELNQVLYRMKKELKVSLTSPATWCLGGTDPEGEGPAELALSSPAERPQQHAATIPETPGPQFSQQREEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGSAGPRHLPSMAPGDSSTWGTLVDPWGPQDIHMEQSILRRVQLGHSNEMRLHGVPSEGPAHIPPGSPPVSATAAGPEASFEARIPSPGTHPEGEAAQRIHMKSCFLEDATIGNSNKMSISPGVAGPGGVAGSGEGEPGEDAGRRPADTQSRSHFPRDIGQPITPSHSKLTPKLETMTLGNRSHKAAEGSHYVDEASHEGSWWGGGI

SEQ ID NO: 146 - protein, 64 aa, Homo sapiens
MPGREGHLEQRILQVLTEAGSPVKLAQLVKECQAPKRELNQVLYRMKKELKVSLTSPATWCLGG

SEQ ID NO: 147 - protein, 65 aa, Homo sapiens
MPQFSQQREEDIYRFLKDNGPQRALVIAQALGMRTAKDVNRDLYRMKSRHLLDMDEQSKAWTIYR

SEQ ID NO: 148 - protein, 991 aa, Capsella rubella
MHRGNEDLSFGDDYEKEIGLLLGEQQRRQEEADEIEKELNLYRSGSAPPTVDGSVNAAGGLFNGGGRGPFMEFGGGNKGNGFGGDDDELRKDPAYLSYYYANMKLNPRLPPPLMSREDLRVAQRLKGSSNVLGGVGDRRNVNESRSLFSMPPGFDQMNEFEAEKTNASSSEWDANGLIGLPGLGLGGKQKSFADIFQPDMGHPVSQQPSRPASRNAFDENVDSTNNQSPSASQGIGAPPPYSYAAVLGSSLSRNGTPDPQAVARVPSPCLTPIGSGRVSSNDKRNTSNQSPFNGVTSGLNESSDLVNALSGMNLSGSGGLDDRGQAEQDVEKVRNYMFGFQGGHNEVSQHVFPNKSDQAQKATGSLRNLHMRGSQGSAYNGGGLANPYQHLDSPNYCLNNYALNPAVASVMANQLGNSNFSPMYDNYSAASALGFSGMDSRLHGGGFESRNLGRSNRMMGGGGLQSHMADPMYHQYGRYSENVDALDLLNDPAMDRSFMGNSYMNMLELQRAYLGAQKSQYGVPYKSGSPNSHSYYGSPTFGSNMSYPGSPLAHHAMQNSLMSPCSPMRRGEVNMRYPSATRNYSGGVMGSWHMDASLDEGFGSSLLEEFKSNKTRGFELSEIAGHVVEFSADQYGSRFIQQKLETATTDEKNMVYEEIMPHALALMTDVFGNYVIQKFFEHGLPPQRRELGDKLFENVLPLSLQMYGCRVIQKAIEVVDLDQKIKMVKELDGHVMRCVRDQNGNHVVQKCIECVPEENIEFIISTFFGHVVSLSTHPYGCRVIQRVLEHCHDPDTQSKVMEEILSTVSMLAQDQYGNYVVQHVLEHGKPDERTVIIKELAGKIVQMSQQKFASNVVEKCLTFGGPEERELLVNEMLGTTDENEPLQAMMKDQFANYVVQKVLETCDDQQRELILTRIKVHLNALKKYTYGKHVVARIEKLVAAGGMHMFLLFPLGLKEENGFAVPNPASDVVRPQVLYSLTRVDGSAIAF

SEQ ID NO: 149 - protein, 320 aa, synthetic construct
  REGION 1..320: note = Elastin-like polypeptide
GRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQ

SEQ ID NO: 150 - protein, 400 aa, synthetic construct
  REGION 1..400: note = Elastin-like polypeptide
GVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVP

SEQ ID NO: 151 - protein, 720 aa, synthetic construct
  REGION 1..720: note = Elastin-like polypeptide
GRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVP

SEQ ID NO: 152 - protein, 12 aa, synthetic construct
  REGION 1..12: note = linker
GKSSGSGSESKS

SEQ ID NO: 153 - protein, 14 aa, synthetic construct
  REGION 1..14: note = linker
GSTSGSGKSSEGKG

SEQ ID NO: 154 - protein, 18 aa, synthetic construct
  REGION 1..18: note = linker
GSTSGSGKSSEGSGSTKG

SEQ ID NO: 155 - protein, 18 aa, synthetic construct
  REGION 1..18: note = linker
GSTSGSGKPGSGEGSTKG

SEQ ID NO: 156 - protein, 14 aa, synthetic construct
  REGION 1..14: note = linker
EGKSSGSGSESKEF

SEQ ID NO: 157 - protein, 5 aa, synthetic construct
  REGION 1..5: note = linker
SRSSG

SEQ ID NO: 158 - protein, 5 aa, synthetic construct
  REGION 1..5: note = linker
SGSSC

SEQ ID NO: 159 - protein, 18 aa, synthetic construct
  REGION 1..18: note = linker
EGRGSLLTCGDVEENPGP

SEQ ID NO: 160 - protein, 19 aa, synthetic construct
  REGION 1..19: note = linker
ATNFSLLKQAGDVEENPGP

SEQ ID NO: 161 - protein, 20 aa, synthetic construct
  REGION 1..20: note = linker
QCTNYALLKLAGDVESNPGP

SEQ ID NO: 162 - protein, 22 aa, synthetic construct
  REGION 1..22: note = linker
VKQTLNFDLLKLAGDVESNPGP

SEQ ID NO: 163 - skipped

SEQ ID NO: 164 - protein, 400 aa, synthetic construct
  REGION 1..400: note = Elastin-like polypeptide
GVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVP

SEQ ID NO: 165 - protein, 320 aa, synthetic construct
  REGION 1..320: note = Resilin-like polypeptide
GRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYS

SEQ ID NO: 166 - protein, 96 aa, Homo sapiens
NRPPIAIVSPQFQEISLPTTSTVIDGSQSTDDDKIVQYHWEELKGPLREEKISEDTAILKLSKLVPGNYTFSLTVVDSDGATNSTTANLTVNKAVD

SEQ ID NO: 167 - protein, 122 aa, synthetic construct
  REGION 1..122: note = capture domain
GITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPS

SEQ ID NO: 168 - protein, 43 aa, synthetic construct
  REGION 1..43: note = capture domain
GPLGSVTCKSGDFSCGGRVNRCIPQFWRCDGQVDCDNGSDEQG

SEQ ID NO: 169 - protein, 37 aa, synthetic construct
  REGION 1..37: note = capture domain
TCSQDEFRCHDGKCISRQFVCDSDRDCLDGSDEASCP

SEQ ID NO: 170 - protein, 50 aa, synthetic construct
  REGION 1..50: note = capture domain
LAEAKVLANRELDKYGVSDFYKRLINKAKTVEGVEALKLHILAALPGGWP

SEQ ID NO: 171 - protein, 59 aa, synthetic construct
  REGION 1..59: note = capture domain
VDNKFNKEQQNAFYEILHLPNLNEEQRNAFIQSLKDDPSQSANLLAEAKKLNDAQAPKG

SEQ ID NO: 172 - protein, 505 aa, synthetic construct
  REGION 1..505: note = purification matrix
MSKGPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPG

SEQ ID NO: 173 - protein, 530 aa, synthetic construct
  REGION 1..530: note = purification matrix
MSKGPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGGITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGY

SEQ ID NO: 174 - protein, 451 aa, synthetic construct
  REGION 1..451: note = purification matrix
MSKGPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGGPLGSVTCKSGDFSCGGRVNRCIPQFWRCDGQVDCDNGSDEQGGY

SEQ ID NO: 175 - protein, 445 aa, synthetic construct
  REGION 1..445: note = purification matrix
MSKGPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGTCSQDEFRCHDGKCISRQFVCDSDRDCLDGSDEASCPGY

SEQ ID NO: 176 - protein, 456 aa, synthetic construct
  REGION 1..456: note = purification matrix
MSKGPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGLAEAKVLANRELDKYGVSDFYKRLINKAKTVEGVEALKLHILAALPGGWP

SEQ ID NO: 177 - protein, 465 aa, synthetic construct
  REGION 1..465: note = purification matrix
MSKGPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVDNKFNKEQQNAFYEILHLPNLNEEQRNAFIQSLKDDPSQSANLLAEAKKLNDAQAPKG

SEQ ID NO: 178 - protein, 385 aa, synthetic construct
  REGION 1..385: note = purification matrix
MSKGPGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGVDNKFNKEQQNAFYEILHLPNLNEEQRNAFIQSLKDDPSQSANLLAEAKKLNDAQAPKG

SEQ ID NO: 179 - protein, 58 aa, Staphylococcus aureus [sequence omitted]

SEQ ID NO: 180 - protein, 3500 aa, synthetic construct
  REGION 1..3500: note = resilin-like polypeptide
  REPEAT 1..7: note = single repeat of (GRGDSPY)n where n=1-500
  VARIANT 8..3500: note = up to 499 copies of (GRGDSPY) can be deleted
GRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPY

SEQ ID NO: 181 - protein, 3500 aa, synthetic construct
  REGION 1..3500: note = resilin-like polypeptide
  REPEAT 1..7: note = single repeat of (GRGDSPH)n where n=1-500
  VARIANT 8..3500: note = up to 499 copies of (GRGDSPH) can be deleted
GRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPH

SEQ ID NO: 182 - protein, 3500 aa, synthetic construct
  REGION 1..3500: note = resilin-like polypeptide
  REPEAT 1..7: note = single repeat of (GRGDSPV)n where n=1-500
  VARIANT 8..3500: note = up to 499 copies of (GRGDSPV) can be deleted
GRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPV

SEQ ID NO: 183 - protein, 4000 aa, synthetic construct
  REGION 1..4000: note = resilin-like polypeptide
  REPEAT 1..8: note = single repeat of (GRGDSPYG)n where n=1-500
  VARIANT 9..4000: note = up to 499 copies of (GRGDSPV) can be deleted
GRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYG

SEQ ID NO: 184 - protein, 3500 aa, synthetic construct
  REGION 1..3500: note = resilin-like polypeptide
  REPEAT 1..7: note = single repeat of (RPLGYDS)n where n=1-500
  VARIANT 8..3500: note = up to 499 copies of (RPLGYDS) can be deleted
RPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDS

SEQ ID NO: 185 - protein, 3500 aa, synthetic construct
  REGION 1..3500: note = resilin-like polypeptide
  REPEAT 1..7: note = single repeat of (RPAGYDS)n where n=1-500
  VARIANT 8..3500: note = up to 499 copies of (RPAGYDS) can be deleted
RPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDS

SEQ ID NO: 186 - protein, 3500 aa, synthetic construct
  REGION 1..3500: note = resilin-like polypeptide
  REPEAT 1..7: note = single repeat of (GRGDSYP)n where n=1-500
  VARIANT 71..3500: note = up to 49 copies of (GRGDSYP) can be deleted
GRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYP

SEQ ID NO: 187 - protein, 4000 aa, synthetic construct
  REGION 1..4000: note = resilin-like polypeptide
  REPEAT 1..8: note = single repeat of (GRGDSPYQ)n where n=1-500
  VARIANT 9..4000: note = up to 49 copies of (GRGDSPYQ) can be deleted
GRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQ

SEQ ID NO: 188 - protein, 4000 aa, synthetic construct
  REGION 1..4000: note = resilin-like polypeptide
  REPEAT 1..8: note = single repeat of (GRGNSPYG)n where n=1-500
  VARIANT 9..4000: note = up to 499 copies of (GRGNSPYG) can be deleted
GRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYG

SEQ ID NO: 189 - protein, 2500 aa, synthetic construct
  REGION 1..2500: note = elastin-like polypeptide
  REPEAT 1..5: note = single repeat of (VPGXG)n where n=1-500
  VARIANT 6..2500: note = up to 499 copies of (VPGXG) can be deleted
  VARIANT 4: note = X can be any amino acid
  VARIANT 9: note = X can be any amino acid
  VARIANT 14: note = X can be any amino acid
  VARIANT 19: note = X can be any amino acid
  VARIANT 24: note = X can be any amino acid
  VARIANT 29: note = X can be any amino acid
  VARIANT 34: note = X can be any amino acid
  VARIANT 39: note = X can be any amino acid
  VARIANT 44: note = X can be any amino acid
  VARIANT 49: note = X can be any amino acid
  VARIANT 54: note = X can be any amino acid
  VARIANT 59: note = X can be any amino acid
  VARIANT 64: note = X can be any amino acid
  VARIANT 69: note = X can be any amino acid
  VARIANT 74: note = X can be any amino acid
  VARIANT 79: note = X can be any amino acid
  VARIANT 84: note = X can be any amino acid
  VARIANT 89: note = X can be any amino acid
  VARIANT 94: note = X can be any amino acid
  VARIANT 99: note = X can be any amino acid
  VARIANT 104: note = X can be any amino acid
  VARIANT 109: note = X can be any amino acid
  VARIANT 114: note = X can be any amino acid
  VARIANT 119: note = X can be any amino acid
  VARIANT 124: note = X can be any amino acid
  VARIANT 129: note = X can be any amino acid
  VARIANT 134: note = X can be any amino acid
  VARIANT 139: note = X can be any amino acid
  VARIANT 144: note = X can be any amino acid
  VARIANT 149: note = X can be any amino acid
  VARIANT 154: note = X can be any amino acid
  VARIANT 159: note = X can be any amino acid
  VARIANT 164: note = X can be any amino acid
  VARIANT 169: note = X can be any amino acid
  VARIANT 174: note = X can be any amino acid
  VARIANT 179: note = X can be any amino acid
  VARIANT 184: note = X can be any amino acid
  VARIANT 189: note = X can be any amino acid
  VARIANT 194: note = X can be any amino acid
  VARIANT 199: note = X can be any amino acid
  VARIANT 204: note = X can be any amino acid
  VARIANT 209: note = X can be any amino acid
  VARIANT 214: note = X can be any amino acid
  VARIANT 219: note = X can be any amino acid
  VARIANT 224: note = X can be any amino acid
  VARIANT 229: note = X can be any amino acid
  VARIANT 234: note = X can be any amino acid
  VARIANT 239: note = X can be any amino acid
  VARIANT 244: note = X can be any amino acid
  VARIANT 249: note = X can be any amino acid
  VARIANT 254: note = X can be any amino acid
  VARIANT 259: note = X can be any amino acid
  VARIANT 264: note = X can be any amino acid
  VARIANT 269: note = X can be any amino acid
  VARIANT 274: note = X can be any amino acid
  VARIANT 279: note = X can be any amino acid
  VARIANT 284: note = X can be any amino acid
  VARIANT 289: note = X can be any amino acid
  VARIANT 294: note = X can be any amino acid
  VARIANT 299: note = X can be any amino acid
  VARIANT 304: note = X can be any amino acid
  VARIANT 309: note = X can be any amino acid
  VARIANT 314: note = X can be any amino acid
  VARIANT 319: note = X can be any amino acid
  VARIANT 324: note = X can be any amino acid
  VARIANT 329: note = X can be any amino acid
  VARIANT 334: note = X can be any amino acid
  VARIANT 339: note = X can be any amino acid
  VARIANT 344: note = X can be any amino acid
  VARIANT 349: note = X can be any amino acid
  VARIANT 354: note = X can be any amino acid
  VARIANT 359: note = X can be any amino acid
  VARIANT 364: note = X can be any amino acid
  VARIANT 369: note = X can be any amino acid
  VARIANT 374: note = X can be any amino acid
  VARIANT 379: note = X can be any amino acid
  VARIANT 384: note = X can be any amino acid
  VARIANT 389: note = X can be any amino acid
  VARIANT 394: note = X can be any amino acid
  VARIANT 399: note = X can be any amino acid
  VARIANT 404: note = X can be any amino acid
  VARIANT 409: note = X can be any amino acid
  VARIANT 414: note = X can be any amino acid
  VARIANT 419: note = X can be any amino acid
  VARIANT 424: note = X can be any amino acid
  VARIANT 429: note = X can be any amino acid
  VARIANT 434: note = X can be any amino acid
  VARIANT 439: note = X can be any amino acid
  VARIANT 444: note = X can be any amino acid
  VARIANT 449: note = X can be any amino acid
  VARIANT 454: note = X can be any amino acid
  VARIANT 459: note = X can be any amino acid
  VARIANT 464: note = X can be any amino acid
  VARIANT 469: note = X can be any amino acid
  VARIANT 474: note = X can be any amino acid
  VARIANT 479: note = X can be any amino acid
  VARIANT 484: note = X can be any amino acid
  VARIANT 489: note = X can be any amino acid
  VARIANT 494: note = X can be any amino acid
  VARIANT 499: note = X can be any amino acid
  VARIANT 504: note = X can be any amino acid
  VARIANT 509: note = X can be any amino acid
  VARIANT 514: note = X can be any amino acid
  VARIANT 519: note = X can be any amino acid
  VARIANT 524: note = X can be any amino acid
  VARIANT 529: note = X can be any amino acid
  VARIANT 534: note = X can be any amino acid
  VARIANT 539: note = X can be any amino acid
  VARIANT 544: note = X can be any amino acid
  VARIANT 549: note = X can be any amino acid
  VARIANT 554: note = X can be any amino acid
  VARIANT 559: note = X can be any amino acid
  VARIANT 564: note = X can be any amino acid
  VARIANT 569: note = X can be any amino acid
  VARIANT 574: note = X can be any amino acid
  VARIANT 579: note = X can be any amino acid
  VARIANT 584: note = X can be any amino acid
  VARIANT 589: note = X can be any amino acid
  VARIANT 594: note = X can be any amino acid
  VARIANT 599: note = X can be any amino acid
  VARIANT 604: note = X can be any amino acid
  VARIANT 609: note = X can be any amino acid
  VARIANT 614: note = X can be any amino acid
  VARIANT 619: note = X can be any amino acid
  VARIANT 624: note = X can be any amino acid
  VARIANT 629: note = X can be any amino acid
  VARIANT 634: note = X can be any amino acid
  VARIANT 639: note = X can be any amino acid
  VARIANT 644: note = X can be any amino acid
  VARIANT 649: note = X can be any amino acid
  VARIANT 654: note = X can be any amino acid
  VARIANT 659: note = X can be any amino acid
  VARIANT 664: note = X can be any amino acid
  VARIANT 669: note = X can be any amino acid
  VARIANT 674: note = X can be any amino acid
  VARIANT 679: note = X can be any amino acid
  VARIANT 684: note = X can be any amino acid
  VARIANT 689: note = X can be any amino acid
  VARIANT 694: note = X can be any amino acid
  VARIANT 699: note = X can be any amino acid
  VARIANT 704: note = X can be any amino acid
  VARIANT 709: note = X can be any amino acid
  VARIANT 714: note = X can be any amino acid
  VARIANT 719: note = X can be any amino acid
  VARIANT 724: note = X can be any amino acid
  VARIANT 729: note = X can be any amino acid
  VARIANT 734: note = X can be any amino acid
  VARIANT 739: note = X can be any amino acid
  VARIANT 744: note = X can be any amino acid
  VARIANT 749: note = X can be any amino acid
  VARIANT 754: note = X can be any amino acid
  VARIANT 759: note = X can be any amino acid
  VARIANT 764: note = X can be any amino acid
  VARIANT 769: note = X can be any amino acid
  VARIANT 774: note = X can be any amino acid
  VARIANT 779: note = X can be any amino acid
  VARIANT 784: note = X can be any amino acid
  VARIANT 789: note = X can be any amino acid
  VARIANT 794: note = X can be any amino acid
  VARIANT 799: note = X can be any amino acid
  VARIANT 804: note = X can be any amino acid
  VARIANT 809: note = X can be any amino acid
  VARIANT 814: note = X can be any amino acid
  VARIANT 819: note = X can be any amino acid
  VARIANT 824: note = X can be any amino acid
  VARIANT 829: note = X can be any amino acid
  VARIANT 834: note = X can be any amino acid
  VARIANT 839: note = X can be any amino acid
  VARIANT 844: note = X can be any amino acid
  VARIANT 849: note = X can be any amino acid
  VARIANT 854: note = X can be any amino acid
  VARIANT 859: note = X can be any amino acid
  VARIANT 864: note = X can be any amino acid
  VARIANT 869: note = X can be any amino acid
  VARIANT 874: note = X can be any amino acid
  VARIANT 879: note = X can be any amino acid
  VARIANT 884: note = X can be any amino acid
  VARIANT 889: note = X can be any amino acid
  VARIANT 894: note = X can be any amino acid
  VARIANT 899: note = X can be any amino acid
  VARIANT 904: note = X can be any amino acid
  VARIANT 909: note = X can be any amino acid
  VARIANT 914: note = X can be any amino acid
  VARIANT 919: note = X can be any amino acid
  VARIANT 924: note = X can be any amino acid
  VARIANT 929: note = X can be any amino acid
  VARIANT 934: note = X can be any amino acid
  VARIANT 939: note = X can be any amino acid
  VARIANT 944: note = X can be any amino acid
  VARIANT 949: note = X can be any amino acid
  VARIANT 954: note = X can be any amino acid
  VARIANT 959: note = X can be any amino acid
  VARIANT 964: note = X can be any amino acid
  VARIANT 969: note = X can be any amino acid
  VARIANT 974: note = X can be any amino acid
  VARIANT 979: note = X can be any amino acid
  VARIANT 984: note = X can be any amino acid
  VARIANT 989: note = X can be any amino acid
  VARIANT 994: note = X can be any amino acid
  VARIANT 999: note = X can be any amino acid
  VARIANT 1004: note = X can be any amino acid
  VARIANT 1009: note = X can be any amino acid
  VARIANT 1014: note = X can be any amino acid
  VARIANT 1019: note = X can be any amino acid
  VARIANT 1024: note = X can be any amino acid
  VARIANT 1029: note = X can be any amino acid
  VARIANT 1034: note = X can be any amino acid
  VARIANT 1039: note = X can be any amino acid
  VARIANT 1044: note = X can be any amino acid
  VARIANT 1049: note = X can be any amino acid
  VARIANT 1054: note = X can be any amino acid
  VARIANT 1059: note = X can be any amino acid
  VARIANT 1064: note = X can be any amino acid
  VARIANT 1069: note = X can be any amino acid
  VARIANT 1074: note = X can be any amino acid
  VARIANT 1079: note = X can be any amino acid
  VARIANT 1084: note = X can be any amino acid
  VARIANT 1089: note = X can be any amino acid
  VARIANT 1094: note = X can be any amino acid
  VARIANT 1099: note = X can be any amino acid
  VARIANT 1104: note = X can be any amino acid
  VARIANT 1109: note = X can be any amino acid
  VARIANT 1114: note = X can be any amino acid
  VARIANT 1119: note = X can be any amino acid
  VARIANT 1124: note = X can be any amino acid
  VARIANT 1129: note = X can be any amino acid
  VARIANT 1134: note = X can be any amino acid
  VARIANT 1139: note = X can be any amino acid
  VARIANT 1144: note = X can be any amino acid
  VARIANT 1149: note = X can be any amino acid
  VARIANT 1154: note = X can be any amino acid
  VARIANT 1159: note = X can be any amino acid
  VARIANT 1164: note = X can be any amino acid
  VARIANT 1169: note = X can be any amino acid
  VARIANT 1174: note = X can be any amino acid
  VARIANT 1179: note = X can be any amino acid
  VARIANT 1184: note = X can be any amino acid
  VARIANT 1189: note = X can be any amino acid
  VARIANT 1194: note = X can be any amino acid
  VARIANT 1199: note = X can be any amino acid
  VARIANT 1204: note = X can be any amino acid
  VARIANT 1209: note = X can be any amino acid
  VARIANT 1214: note = X can be any amino acid
  VARIANT 1219: note = X can be any amino acid
  VARIANT 1224: note = X can be any amino acid
  VARIANT 1229: note = X can be any amino acid
  VARIANT 1234: note = X can be any amino acid
  VARIANT 1239: note = X can be any amino acid
  VARIANT 1244: note = X can be any amino acid
  VARIANT 1249: note = X can be any amino acid
  VARIANT 1254: note = X can be any amino acid
  VARIANT 1259: note = X can be any amino acid
  VARIANT 1264: note = X can be any amino acid
  VARIANT 1269: note = X can be any amino acid
  VARIANT 1274: note = X can be any amino acid
  VARIANT 1279: note = X can be any amino acid
  VARIANT 1284: note = X can be any amino acid
  VARIANT 1289: note = X can be any amino acid
  VARIANT 1294: note = X can be any amino acid
  VARIANT 1299: note = X can be any amino acid
  VARIANT 1304: note = X can be any amino acid
  VARIANT 1309: note = X can be any amino acid
  VARIANT 1314: note = X can be any amino acid
  VARIANT 1319: note = X can be any amino acid
  VARIANT 1324: note = X can be any amino acid
  VARIANT 1329: note = X can be any amino acid
  VARIANT 1334: note = X can be any amino acid
  VARIANT 1339: note = X can be any amino acid
  VARIANT 1344: note = X can be any amino acid
  VARIANT 1349: note = X can be any amino acid
  VARIANT 1354: note = X can be any amino acid
  VARIANT 1359: note = X can be any amino acid
  VARIANT 1364: note = X can be any amino acid
  VARIANT 1369: note = X can be any amino acid
  VARIANT 1374: note = X can be any amino acid
  VARIANT 1379: note = X can be any amino acid
  VARIANT 1384: note = X can be any amino acid
  VARIANT 1389: note = X can be any amino acid
  VARIANT 1394: note = X can be any amino acid
  VARIANT 1399: note = X can be any amino acid
  VARIANT 1404: note = X can be any amino acid
  VARIANT 1409: note = X can be any amino acid
  VARIANT 1414: note = X can be any amino acid
  VARIANT 1419: note = X can be any amino acid
  VARIANT 1424: note = X can be any amino acid
  VARIANT 1429: note = X can be any amino acid
  VARIANT 1434: note = X can be any amino acid
  VARIANT 1439: note = X can be any amino acid
  VARIANT 1444: note = X can be any amino acid
  VARIANT 1449: note = X can be any amino acid
  VARIANT 1454: note = X can be any amino acid
  VARIANT 1459: note = X can be any amino acid
  VARIANT 1464: note = X can be any amino acid
  VARIANT 1469: note = X can be any amino acid
  VARIANT 1474: note = X can be any amino acid
  VARIANT 1479: note = X can be any amino acid
  VARIANT 1484: note = X can be any amino acid
  VARIANT 1489: note = X can be any amino acid
  VARIANT 1494: note = X can be any amino acid
  VARIANT 1499: note = X can be any amino acid
  VARIANT 1504: note = X can be any amino acid
  VARIANT 1509: note = X can be any amino acid
  VARIANT 1514: note = X can be any amino acid
  VARIANT 1519: note = X can be any amino acid
  VARIANT 1524: note = X can be any amino acid
  VARIANT 1529: note = X can be any amino acid
  VARIANT 1534: note = X can be any amino acid
  VARIANT 1539: note = X can be any amino acid
  VARIANT 1544: note = X can be any amino acid
  VARIANT 1549: note = X can be any amino acid
  VARIANT 1554: note = X can be any amino acid
  VARIANT 1559: note = X can be any amino acid
  VARIANT 1564: note = X can be any amino acid
  VARIANT 1569: note = X can be any amino acid
  VARIANT 1574: note = X can be any amino acid
  VARIANT 1579: note = X can be any amino acid
  VARIANT 1584: note = X can be any amino acid
  VARIANT 1589: note = X can be any amino acid
  VARIANT 1594: note = X can be any amino acid
  VARIANT 1599: note = X can be any amino acid
  VARIANT 1604: note = X can be any amino acid
  VARIANT 1609: note = X can be any amino acid
  VARIANT 1614: note = X can be any amino acid
  VARIANT 1619: note = X can be any amino acid
  VARIANT 1624: note = X can be any amino acid
  VARIANT 1629: note = X can be any amino acid
  VARIANT 1634: note = X can be any amino acid
  VARIANT 1639: note = X can be any amino acid
  VARIANT 1644: note = X can be any amino acid
  VARIANT 1649: note = X can be any amino acid
  VARIANT 1654: note = X can be any amino acid
  VARIANT 1659: note = X can be any amino acid
  VARIANT 1664: note = X can be any amino acid
  VARIANT 1669: note = X can be any amino acid
  VARIANT 1674: note = X can be any amino acid
  VARIANT 1679: note = X can be any amino acid
  VARIANT 1684: note = X can be any amino acid
  VARIANT 1689: note = X can be any amino acid
  VARIANT 1694: note = X can be any amino acid
  VARIANT 1699: note = X can be any amino acid
  VARIANT 1704: note = X can be any amino acid
  VARIANT 1709: note = X can be any amino acid
  VARIANT 1714: note = X can be any amino acid
  VARIANT 1719: note = X can be any amino acid
  VARIANT 1724: note = X can be any amino acid
  VARIANT 1729: note = X can be any amino acid
  VARIANT 1734: note = X can be any amino acid
  VARIANT 1739: note = X can be any amino acid
  VARIANT 1744: note = X can be any amino acid
  VARIANT 1749: note = X can be any amino acid
  VARIANT 1754: note = X can be any amino acid
  VARIANT 1759: note = X can be any amino acid
  VARIANT 1764: note = X can be any amino acid
  VARIANT 1769: note = X can be any amino acid
  VARIANT 1774: note = X can be any amino acid
  VARIANT 1779: note = X can be any amino acid
  VARIANT 1784: note = X can be any amino acid
  VARIANT 1789: note = X can be any amino acid
  VARIANT 1794: note = X can be any amino acid
  VARIANT 1799: note = X can be any amino acid
  VARIANT 1804: note = X can be any amino acid
  VARIANT 1809: note = X can be any amino acid
  VARIANT 1814: note = X can be any amino acid
  VARIANT 1819: note = X can be any amino acid
  VARIANT 1824: note = X can be any amino acid
  VARIANT 1829: note = X can be any amino acid
  VARIANT 1834: note = X can be any amino acid
  VARIANT 1839: note = X can be any amino acid
  VARIANT 1844: note = X can be any amino acid
  VARIANT 1849: note = X can be any amino acid
  VARIANT 1854: note = X can be any amino acid
  VARIANT 1859: note = X can be any amino acid
  VARIANT 1864: note = X can be any amino acid
  VARIANT 1869: note = X can be any amino acid
  VARIANT 1874: note = X can be any amino acid
  VARIANT 1879: note = X can be any amino acid
  VARIANT 1884: note = X can be any amino acid
  VARIANT 1889: note = X can be any amino acid
  VARIANT 1894: note = X can be any amino acid
  VARIANT 1899: note = X can be any amino acid
  VARIANT 1904: note = X can be any amino acid
  VARIANT 1909: note = X can be any amino acid
  VARIANT 1914: note = X can be any amino acid
  VARIANT 1919: note = X can be any amino acid
  VARIANT 1924: note = X can be any amino acid
  VARIANT 1929: note = X can be any amino acid
  VARIANT 1934: note = X can be any amino acid
  VARIANT 1939: note = X can be any amino acid
  VARIANT 1944: note = X can be any amino acid
  VARIANT 1949: note = X can be any amino acid
  VARIANT 1954: note = X can be any amino acid
  VARIANT 1959: note = X can be any amino acid
  VARIANT 1964: note = X can be any amino acid
  VARIANT 1969: note = X can be any amino acid
  VARIANT 1974: note = X can be any amino acid
  VARIANT 1979: note = X can be any amino acid
  VARIANT 1984: note = X can be any amino acid
  VARIANT 1989: note = X can be any amino acid
  VARIANT 1994: note = X can be any amino acid
  VARIANT 1999: note = X can be any amino acid
  VARIANT 2004: note = X can be any amino acid
  VARIANT 2009: note = X can be any amino acid
  VARIANT 2014: note = X can be any amino acid
  VARIANT 2019: note = X can be any amino acid
  VARIANT 2024: note = X can be any amino acid
  VARIANT 2029: note = X can be any amino acid
  VARIANT 2034: note = X can be any amino acid
  VARIANT 2039: note = X can be any amino acid
  VARIANT 2044: note = X can be any amino acid
  VARIANT 2049: note = X can be any amino acid
  VARIANT 2054: note = X can be any amino acid
  VARIANT 2059: note = X can be any amino acid
  VARIANT 2064: note = X can be any amino acid
  VARIANT 2069: note = X can be any amino acid
  VARIANT 2074: note = X can be any amino acid
  VARIANT 2079: note = X can be any amino acid
  VARIANT 2084: note = X can be any amino acid
  VARIANT 2089: note = X can be any amino acid
  VARIANT 2094: note = X can be any amino acid
  VARIANT 2099: note = X can be any amino acid
  VARIANT 2104: note = X can be any amino acid
  VARIANT 2109: note = X can be any amino acid
  VARIANT 2114: note = X can be any amino acid
  VARIANT 2119: note = X can be any amino acid
  VARIANT 2124: note = X can be any amino acid
  VARIANT 2129: note = X can be any amino acid
  VARIANT 2134: note = X can be any amino acid
  VARIANT 2139: note = X can be any amino acid
  VARIANT 2144: note = X can be any amino acid
  VARIANT 2149: note = X can be any amino acid
  VARIANT 2154: note = X can be any amino acid
  VARIANT 2159: note = X can be any amino acid
  VARIANT 2164: note = X can be any amino acid
  VARIANT 2169: note = X can be any amino acid
  VARIANT 2174: note = X can be any amino acid
  VARIANT 2179: note = X can be any amino acid
  VARIANT 2184: note = X can be any amino acid
  VARIANT 2189: note = X can be any amino acid
  VARIANT 2194: note = X can be any amino acid
  VARIANT 2199: note = X can be any amino acid
  VARIANT 2204: note = X can be any amino acid
  VARIANT 2209: note = X can be any amino acid
  VARIANT 2214: note = X can be any amino acid
  VARIANT 2219: note = X can be any amino acid
  VARIANT 2224: note = X can be any amino acid
  VARIANT 2229: note = X can be any amino acid
  VARIANT 2234: note = X can be any amino acid
  VARIANT 2239: note = X can be any amino acid
  VARIANT 2244: note = X can be any amino acid
  VARIANT 2249: note = X can be any amino acid
  VARIANT 2254: note = X can be any amino acid
  VARIANT 2259: note = X can be any amino acid
  VARIANT 2264: note = X can be any amino acid
  VARIANT 2269: note = X can be any amino acid
  VARIANT 2274: note = X can be any amino acid
  VARIANT 2279: note = X can be any amino acid
  VARIANT 2284: note = X can be any amino acid
  VARIANT 2289: note = X can be any amino acid
  VARIANT 2294: note = X can be any amino acid
  VARIANT 2299: note = X can be any amino acid
  VARIANT 2304: note = X can be any amino acid
  VARIANT 2309: note = X can be any amino acid
  VARIANT 2314: note = X can be any amino acid
  VARIANT 2319: note = X can be any amino acid
  VARIANT 2324: note = X can be any amino acid
  VARIANT 2329: note = X can be any amino acid
  VARIANT 2334: note = X can be any amino acid
  VARIANT 2339: note = X can be any amino acid
  VARIANT 2344: note = X can be any amino acid
  VARIANT 2349: note = X can be any amino acid
  VARIANT 2354: note = X can be any amino acid
  VARIANT 2359: note = X can be any amino acid
  VARIANT 2364: note = X can be any amino acid
  VARIANT 2369: note = X can be any amino acid
  VARIANT 2374: note = X can be any amino acid
  VARIANT 2379: note = X can be any amino acid
  VARIANT 2384: note = X can be any amino acid
  VARIANT 2389: note = X can be any amino acid
  VARIANT 2394: note = X can be any amino acid
  VARIANT 2399: note = X can be any amino acid
  VARIANT 2404: note = X can be any amino acid
  VARIANT 2409: note = X can be any amino acid
  VARIANT 2414: note = X can be any amino acid
  VARIANT 2419: note = X can be any amino acid
  VARIANT 2424: note = X can be any amino acid
  VARIANT 2429: note = X can be any amino acid
  VARIANT 2434: note = X can be any amino acid
  VARIANT 2439: note = X can be any amino acid
  VARIANT 2444: note = X can be any amino acid
  VARIANT 2449: note = X can be any amino acid
  VARIANT 2454: note = X can be any amino acid
  VARIANT 2459: note = X can be any amino acid
  VARIANT 2464: note = X can be any amino acid
  VARIANT 2469: note = X can be any amino acid
  VARIANT 2474: note = X can be any amino acid
  VARIANT 2479: note = X can be any amino acid
  VARIANT 2484: note = X can be any amino acid
  VARIANT 2489: note = X can be any amino acid
  VARIANT 2494: note = X can be any amino acid
  VARIANT 2499: note = X can be any amino acid
VPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXG

SEQ ID NO: 190 - protein, 2500 aa, synthetic construct
  REGION 1..2500: note = elastin-like polypeptide
  REPEAT 1..5: note = single repeat of (GVGVP)n where n=1-500
  VARIANT 6..2500: note = up to 499 copies of (GVGVP) can be deleted
GVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVP

SEQ ID NO: 191 - protein, 400 aa, synthetic construct; identical to SEQ ID NO: 164
  REGION 1..400: note = elastin-like polypeptide

SEQ ID NO: 192 - protein, 400 aa, synthetic construct
  REGION 1..400: note = elastin-like polypeptide
  REPEAT 1..25: note = single repeat of (GVGVPGVGVPGAGVPGVGVPGVGVP)m where; m = 8-16
  VARIANT 201..400: note = up to 8 copies of (GVGVPGVGVPGAGVPGVGVPGVGVP) can be deleted
GVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVP

SEQ ID NO: 193 - protein, 400 aa, synthetic construct; identical to SEQ ID NO: 192
  REGION 1..400: note = elastin-like polypeptide
  REPEAT 1..25: note = single repeat of (GVGVPGVGVPGAGVPGVGVPGVGVP)m where; m = 8 or 16
  VARIANT 201..400: note = 8 copies of (GVGVPGVGVPGAGVPGVGVPGVGVP) can be deleted

What is claimed is:

1. A method of purifying a viral particle comprising:

(i) contacting the viral particle with a fusion protein comprising (a) at least one low-density lipoprotein receptor (LDLR) or an extracellular domain thereof; and (b) at least one polypeptide with phase behavior, wherein the fusion protein binds to the viral particle and forms a complex;

(ii) contacting the complex with a first environmental factor;

(iii) separating the complex from at least one contaminant; and (iv) separating the viral particle from the fusion protein by contacting the complex with a second environmental factor.

2. The method of claim 1, wherein the LDLR or an extracellular domain thereof comprises the sequence of any one of SEQ ID NO: 73-76 or 168-169, or a sequence with at least 90% identity thereto.

3. The method of claim 1, wherein the LDLR or an extracellular domain thereof comprises the sequence of any one of SEQ ID NO: 73-76 or 168-169, or a sequence with at least 95% identity thereto.

4. The method of claim 1, wherein the LDLR or an extracellular domain thereof comprises the sequence of any one of SEQ ID NO: 73-76 or 168-169, or a sequence with at least 97% identity thereto.

5. The method of claim 1, wherein the LDLR or an extracellular domain thereof comprises the sequence of any one of SEQ ID NO: 73-76 or 168-169, or a sequence with at least 99% identity thereto.

6. The method of claim 1, wherein the LDLR or an extracellular domain thereof comprises the amino acid sequence of any one of:

(a) amino acids 2-860 of SEQ ID NO: 73;

(b) amino acids 2-768 of SEQ ID NO: 74;

(c) amino acids 2-40 of SEQ ID NO: 75;

(d) amino acids 2-38 of SEQ ID NO: 76;

(e) SEQ ID NO: 168; or (f) SEQ ID NO: 169.

7. The method of claim 1, wherein the LDLR or an extracellular domain thereof comprises the amino acid sequence of SEQ ID NO: 169.

8. The method of claim 7, wherein:

the polypeptide with phase behavior comprises the amino acid sequence of (GVGVP)m, wherein m is 80.

9. The method of claim 1, wherein the polypeptide with phase behavior is an elastin-like polypeptide (ELP).

10. The method of claim 9, wherein the ELP is a polymer containing a pentapeptide repeat having the sequence (Val-Pro-Gly-Xaa-Gly)n (SEQ ID NO: 10);

wherein Xaa can be any amino acid except proline; and wherein n is an integer from 1 to 360, inclusive of endpoints.

11. The method of claim 1, wherein the polypeptide with phase behavior comprises an amino acid sequence selected from:

(a) (GRGDSPY)n (SEQ ID NO: 1);

(b) (GRGDSPH)n (SEQ ID NO: 2);

(c) (GRGDSPV)n (SEQ ID NO: 3);

(d) (GRGDSPYG)n (SEQ ID NO: 4);

(e) (RPLGYDS)n (SEQ ID NO: 5);

(f) (RPAGYDS)n (SEQ ID NO: 6);

(g) (GRGDSYP)n (SEQ ID NO: 7);

(h) (GRGDSPYQ)n (SEQ ID NO: 8);

(i) (GRGNSPYG)n (SEQ ID NO: 9);

(j) (GVGVP)n (SEQ ID NO: 11);

(k) (GVGVPGLGVPGVGVPGLGVPGVGVP)m (SEQ ID NO: 12);

(l) (GVGVPGVGVPGAGVPGVGVPGVGVP)m (SEQ ID NO: 13);

(m) (GVGVPGWGVPGVGVPGWGVPGVGVP)m (SEQ ID NO: 14);

(n) (GVGVPGVGVPGVGVPGVGVPGVGVPGVGVP-GEGVPG FGVPGVGVP)m (SEQ ID NO: 15);

(o) (GVGVPGVGVPGVGVPGVGVPGVGVPG-VGVPGKGVPG FGVPGVGVP)m (SEQ ID NO: 16); and (p) (GAGVPGVGVPGAGVPGVGVPGAGVP)m (SEQ ID NO: 17);

wherein n is an integer in the range of 20-360, inclusive of endpoints; and m is an integer in the range of 4-25, inclusive of endpoints.

12. The method of claim 1, wherein the polypeptide with phase behavior comprises an amino acid sequence selected from:

(a) (GVGVP)m (SEQ ID NO: 52);

(b) (ZZPXXXXGZ)m (SEQ ID NO: 57);

(c) (ZZPXGZ)m (SEQ ID NO: 58);

(d) (ZZPXXGZ)m (SEQ ID NO: 59); or (e) (ZZPXXXGZ)m (SEQ ID NO: 60);

wherein m is an integer between 10 and 160, inclusive of endpoints;

wherein X if present is any amino acid except proline or glycine; and wherein Z if present is any amino acid.

13. The method of claim 1, wherein the polypeptide with phase behavior comprises an amino acid sequence selected from:

(a) (GVGVPGVGVPGAGVPGVGVPGVGVP)m (SEQ ID NO: 53); and (b) (GVGVPGVGVPGLGVPGVGVPGVGVP)m (SEQ ID NO: 55);

wherein m is an integer between 2 and 32, inclusive of endpoints.

14. The method of claim 1, wherein the polypeptide with phase behavior comprises an amino acid sequence selected from any one of:

(a) (GVGVPGVGVPGAGVPGVGVPGVGVP)m (SEQ ID NO: 193), wherein m is 8 or 16;

(b) (GVGVPGAGVP)m (SEQ ID NO: 54), wherein m is an integer between 5 and 80, inclusive of endpoints; and (c) (GXGVP)m (SEQ ID NO: 56), wherein m is an integer between 10 and 160, inclusive of endpoints, wherein each X is independently selected from the group consisting of glycine, alanine, valine, isoleucine, leucine, phenylalanine, tyrosine, tryptophan, lysine, arginine, aspartic acid, glutamic acid, and serine.

15. The method of claim 1, wherein the polypeptide with phase behavior comprises the amino acid sequence of (GVGVP)m, wherein m is 80.

16. The method of claim 1, wherein contacting the viral particle with the fusion protein comprises adding the fusion protein to tissue culture media of cells producing the viral particle.

17. The method of claim 1, wherein the first environmental factor is selected from the group consisting of: a change in temperature, a change in pH, a change in salt concentration, a change in the concentration of the fusion protein, a change in the concentration of the viral particle, a change in pressure, the addition of a surfactant, the addition of a cofactor, the addition of a vitamin, the addition of a molecular crowding agent, the addition of a reducing agent, the addition of an oxidizing agent, the addition of an enzyme, the addition of a denaturing agent, the application of electromagnetic waves, the application of acoustic waves, or a combination thereof.

18. The method of claim 1, wherein the second environmental factor is selected from the group consisting of: a change in temperature, a change in pH, a change in salt concentration, a change in the concentration of the fusion protein, a change in the concentration of the viral particle, a change in pressure, the addition of a surfactant, the addition of a cofactor, the addition of a vitamin, the addition of a molecular crowding agent, the addition of a reducing agent, the addition of an oxidizing agent, the addition of an enzyme, the addition of a denaturing agent, the application of electromagnetic waves, the application of acoustic waves, or a combination thereof.

19. The method of claim 1, comprising separating the complex from at least one contaminant by a method selected from the group consisting of: tangential flow filtration, membrane chromatography, analytical ultracentrifugation, high performance liquid chromatography, membrane chromatography, normal flow filtration, acoustic wave separation, centrifugation, counterflow centrifugation, and fast protein liquid chromatography.

20. The method of claim 1, wherein the first environmental factor is the addition of salt.

21. The method of claim 1, wherein a purification yield of the viral particle is at least 70%.

* * * * *